United States Patent 12,569,549 (FLAVIVIRUS VACCINE) - sequence listing, part 46

SEQ ID NO: 16849 - RNA, 9879 nt, synthetic construct
  misc_feature 1..9879: note = derived and/or modified CDS sequence (opt4) from DENV-1__KM403631__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccatcaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16850 - RNA, 9879 nt, synthetic construct
  misc_feature 1..9879: note = derived and/or modified CDS sequence (opt4) from DENV-1__KM403632__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcagatgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16851 - RNA, 9879 nt, synthetic construct
  misc_feature 1..9879: note = derived and/or modified CDS sequence (opt4) from DENV-1__KM403583__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacagaagaagcgtggccctggccccccacgtgggcctgggcctggagaccagaaccgagacctggatgagcagcgagggcgcctggagacagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccatcttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16852 - RNA, 9879 nt, synthetic construct
  misc_feature 1..9879: note = derived and/or modified CDS sequence (opt4) from DENV-1__KM403579__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctgggcaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaaagctgatcggcaacgagaactacctggactacatgaccagcatgaagagattcaagaacgagagcgaccccgagggcgccctgtggtga

SEQ ID NO: 16853 - RNA, 9879 nt, synthetic construct
  misc_feature 1..9879: note = derived and/or modified CDS sequence (opt4) from DENV-1__HM469968__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgccctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16854 - RNA, 9879 nt, synthetic construct
  misc_feature 1..9879: note = derived and/or modified CDS sequence (opt4) from DENV-1__KC172834__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccaggccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacctgggccacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatcctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccaacgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggggcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16855 - RNA, 9879 nt, synthetic construct
  misc_feature 1..9879: note = derived and/or modified CDS sequence (opt4) from DENV-1__KJ933413__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcaccggcgtgaacatgtgcaccctgatcgccatggacctgggcgagctgtgcgaggacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccctggtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcaccagccaggacgagaagggcgtgacccagaacggcagactgatcaccgccaaccccatcgtgaccgacaaggagaagcccgtgaacatcgaggccgagccccccttcggcgagagctacctggtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgtgaccagactggagaacatcatgtggaagcagatcagcaacgagctgaaccacatcctgctggagaacgacatgaagttcaccgtggtggtgggcgacgtgaacggcatcctggcccagggcaagaagatgatcagaccccagcccatggagcacaagtacagctggaagagctggggcaaggccaaggtgatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctgaccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcggcctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagagccaccagctgtgggccgccctgctgagcctgaccttcgtgaagaccaccttcagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcaccgagaacagaatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcaagagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcatggaggccttcccccagagcaacgccgccatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtggtgcagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagagccaccaccacgccgccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaaggtgctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccaagaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcatcgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16856 - RNA, 9879 nt, synthetic construct
  misc_feature 1..9879: note = derived and/or modified CDS sequence (opt4) from DENV-1__KU666942__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcaccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagatacagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcatggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatcgccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccgtgcccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccatcaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagtgcgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgagatcatggagcccgagcacgcccagctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatgaaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16857 - RNA, 9879 nt, synthetic construct
  misc_feature 1..9879: note = derived and/or modified CDS sequence (opt4) from DENV-1__KU666939__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggtgctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcctgcccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgatccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgctgctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcatcgacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctgggcaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16858 - RNA, 9879 nt, synthetic construct
  misc_feature 1..9879: note = derived and/or modified CDS sequence (opt4) from DENV-1__KU666940__SS-prME
  source 1..9879: mol_type = other RNA
agcgtgaccatgctgctgatgctgacccccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagatacagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatcgccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccgtgcccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccatcaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagtgcgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgagatcatggagcccgagcacgcccagctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatgaaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16859 - RNA, 9879 nt, synthetic construct
  misc_feature 1..9879: note = derived and/or modified CDS sequence (opt4) from DENV-1__KU666941__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcggcgccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagatacagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatcgccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccgtgcccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccatcaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagtgcgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgagatcatggagcccgagcacgcccagctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatgaaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16860 - RNA, 9879 nt, synthetic construct
  misc_feature 1..9879: note = derived and/or modified CDS sequence (opt4) from DENV-1__KC172835__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtggtgaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacgtgatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgagactgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagaccatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatcggccagctgacctggaacgacctgatcagactgagcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagccccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgccctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgacgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggtgcacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcatcgacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagagcgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcagccaggtgagaagactgatcggcaacgagaactacctggactacatgaccagcatgaagagattcaagaacgagagcgaccccgagggcgccctgtggtga

SEQ ID NO: 16861 - RNA, 9879 nt, synthetic construct
  misc_feature 1..9879: note = derived and/or modified CDS sequence (opt4) from DENV-1__EU848545__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccatcatcgccatggacctgggcgagctgtgcgaggacaccatgacctacaagtgccccagaatcaccaaggccgagcccgacgacgtggactgctggtgcaacgccaccgacacctgggtgacctacggcacctgcagcagaaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaagcccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccccccaggagacctggaacagagaggacctgctggtgaccttcaagaccgcccacgccaagaagcaggaggtggtggtgctgggcagccaggagggcgccatgcacaccgccctgaccggcgccaccgagatccagaccagcggcaccaccaagatcttcgccggccacctgaagtgcagactgaagatgaacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgctggaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcgccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctgacccagggcagaaagatgatcggcccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccccagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacagcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggacaaggaggagaacctggtgaagagcctggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccgccctgctgagcctgaccttcatcaagaccaccttcagcctgcactacgcctggaagaccgtggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgagatcagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatcagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagaggcaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaaagtggtgcttcgacggcgagagaaacaaccaggtgctggaggagaacatggacgtggagatctggaccaaggagggcgagagaaagaagctgagacccagatggctggacgccagaacctacagcgacccccaggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtgggtggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgagacccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgatcgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccatcgactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacctggagggcgccctgtggtga

SEQ ID NO: 16862 - RNA, 9879 nt, synthetic construct
  misc_feature 1..9879: note = derived and/or modified CDS sequence (opt4) from DENV-1__KR024708__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggagagcttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16863 - RNA, 9879 nt, synthetic construct
  misc_feature 1..9879: note = derived and/or modified CDS sequence (opt4) from DENV-1__KR024705__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacgccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16864 - RNA, 9879 nt, synthetic construct
  misc_feature 1..9879: note = derived and/or modified CDS sequence (opt4) from DENV-1__KR024706__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccggcgccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccctggtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgggcggcgaggccagaaagaccttcgtggagctgatgaagagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagctggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16865 - RNA, 9879 nt, synthetic construct
  misc_feature 1..9879: note = derived and/or modified CDS sequence (opt4) from DENV-1__KR024707__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctgaccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16866 - RNA, 9879 nt, synthetic construct
  misc_feature 1..9879: note = derived and/or modified CDS sequence (opt4) from DENV-1__KC172829__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcaccttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtggtgaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgagactgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatcggccagctgacctggaacgacctgatcagactgagcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccaccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttcagcggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgacgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggtgcacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagagcgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcagccaggtgagaagactgatcggcaacgagaactacctggactacatgaccagcatgaagagattcaagaacgagagcgaccccgagggcgccctgtggtga

SEQ ID NO: 16867 - RNA, 9879 nt, synthetic construct
  misc_feature 1..9879: note = derived and/or modified CDS sequence (opt4) from DENV-1__EU359008__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccacccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgccctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccaggtgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgccatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16868 - RNA, 9879 nt, synthetic construct
  misc_feature 1..9879: note = derived and/or modified CDS sequence (opt4) from DENV-1__AY835999__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagctgggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggtgcagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgagaacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcatcctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccagaccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccctgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgcccagctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccaacgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16869 - RNA, 9879 nt, synthetic construct
  misc_feature 1..9879: note = derived and/or modified CDS sequence (opt4) from DENV-1__KP686070__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgagcatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16870 - RNA, 9876 nt, synthetic construct
  misc_feature 1..9876: note = derived and/or modified CDS sequence (opt4) from DENV-1__KF672760__SS-prME
  source 1..9876: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatgatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggcctgcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtgg

SEQ ID NO: 16871 - RNA, 9876 nt, synthetic construct
  misc_feature 1..9876: note = derived and/or modified CDS sequence (opt4) from DENV-1__KF672759__SS-prME
  source 1..9876: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgtgaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgacctgcagagaggtgctgctgctgaccgtgggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccaaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccacccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggagggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagaaggtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtgg

SEQ ID NO: 16872 - RNA, 9876 nt, synthetic construct
  misc_feature 1..9876: note = derived and/or modified CDS sequence (opt4) from DENV-1__KF672761__SS-prME
  source 1..9876: mol_type = other RNA
agcgtgaccatgctgttcatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcggccacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtgg

SEQ ID NO: 16873 - RNA, 9876 nt, synthetic construct
  misc_feature 1..9876: note = derived and/or modified CDS sequence (opt4) from DENV-1__KF672762__SS-prME
  source 1..9876: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcatcgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgctgggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcagaaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccatcgactgggtgcccaccagcagaaccacctggagcatccacgcccaccaccagtggatgaccaccgaggacatgctgagcgtgtggaacagagtgtggatcgaggagaacccctggatggaggacaaggcccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtgg

SEQ ID NO: 16874 - RNA, 9879 nt, synthetic construct
  misc_feature 1..9879: note = derived and/or modified CDS sequence (opt4) from DENV-1__JF459993__SS-prME
  source 1..9879: mol_type = other RNA
agcgtgaccatgctgttcatgctgctgcccaccagcctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgggccaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgatccagaacggcagactgatcaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacgccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaaccacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccctggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccagcatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgaggagatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagaggtggtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16875 - RNA, 9876 nt, synthetic construct
  misc_feature 1..9876: note = derived and/or modified CDS sequence (opt4) from DENV-1__KF672763__SS-prME
  source 1..9876: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatcaagttcaccgtggtggtgggcaacgccgacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccatcagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctgatggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacgagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacctgggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgagaaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcttccccagcgagctggagagccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtgg

SEQ ID NO: 16876 - RNA, 9876 nt, synthetic construct
  misc_feature 1..9876: note = derived and/or modified CDS sequence (opt4) from DENV-1__KF672764__SS-prME
  source 1..9876: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatcaagttcaccgtggtggtgggcaacgccaacggcatcctgacccagggcaagaagatgatcagaccccagcccatggagcacaagtacagctggaagagctggggcaaggccaagatcatcggcgccgacatccagaacaccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccatcagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacctgggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaaccgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcttccccagcgagctggagagccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtgg

SEQ ID NO: 16877 - RNA, 9879 nt, synthetic construct
  misc_feature 1..9879: note = derived and/or modified CDS sequence (opt4) from DENV-1__EU863650__SS-prME
  source 1..9879: mol_type = other RNA
agcgtgaccatgctgctgatgctgctgcccaccgtgctgaccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgacgacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatcagctacgtgatgtgcaccggcctgttcaagctggagaaggaggtggccgagacccagcacggcaccgtgctggtgcaggtgaagtacgagggcaccgacgccccctgcaagatccccttcagcagccaggacgagaagggcgccacccagaacggcagactggtgaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagaccatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagccacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggtggtgttcctgctgctgaccctgggccagctgacctggaacgacctgatcagactgtgcatcatggtgggcgccaacgccagcgacaacatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggacgagctgggcgacggcctggccatgggcatcatgatcctgaagctgctgaccgacttccagagccaccagctgtgggccaccctgctgagcctgaccttcgtgaagaccaccctgagcctgcactacgcctggaagaccatggccatgatcctgagcatcgtgagcctgctgcccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccaaggtgagctgggaggaggaggccgagcacagcggcgccagccacaacatcctggtggagatccaggacgacggcaccatgaagatcaaggacgaggagagagacgacaccatcaccatcctgctgaaggccaccctgctggccatcagcggcgtgtaccccatgagcatccccgccaccctgttcgtgtggcacttctggcagaagaagaagcagagaagcggcgtgctgtgggacacccccagcccccccgaggtggagaaggccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaaggccctggacaacctggtgatgctgcacaacagcgagcagggcggcaaggcctacagacacgccatggaggagctgcccgacaccatcgagaccatcatgctgctggccctgatcgccgtgctgaccggcggcgtgaccctgttcttcctgagcggcagaggcctgggcaagaccagcatcggcctgctgtgcgtgaccagcagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaccgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaagacctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggcagcaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagccccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagccccccaacctggccggcagagtgcccgactggctggagaagcacggcaccgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16878 - RNA, 9879 nt, synthetic construct
  misc_feature 1..9879: note = derived and/or modified CDS sequence (opt4) from DENV-1__KU365900__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggccccggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgctgagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaaagtggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcatcgacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctgggcaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16879 - RNA, 9879 nt, synthetic construct
  misc_feature 1..9879: note = derived and/or modified CDS sequence (opt4) from DENV-1__FJ176779__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctggtggccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagaactggggcaaggccaagatcatcggcgccgacgtgcagaacagcaccttcatcatcgacggccccaacacccccgagtgcagcgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcatgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccaaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagatgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgagttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtgaccaacctggacatcatcggccagagaatcgagaacatcaagtacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggagcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccaacgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16880 - RNA, 9879 nt, synthetic construct
  misc_feature 1..9879: note = derived and/or modified CDS sequence (opt4) from DENV-1__FJ176780__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaccagcctggaggagctgggcgacggcctggccatgggcatcatgatcctgaagctgctgaccgacttccagagccaccagctgtgggccaccctgctgagcctgaccttcgtgaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggctaccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtgaccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatctaccaggtgagaagactgatcggcaacgagaactacctggactacatgaccagcatgaagagattcaagaacgagagcgaccccgagggcgccctgtggtga

SEQ ID NO: 16881 - RNA, 9879 nt, synthetic construct
  misc_feature 1..9879: note = derived and/or modified CDS sequence (opt4) from DENV-1__JN205310__SS-prME
  source 1..9879: mol_type = other RNA
agcgtgaccgtgctgttcatgctgctgcccaccgccctggccttccacctgaccaccctgggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggccccagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccaccgccatcatcaccccccaggcccccaccagcgagatccagctgaccgactacggcgccctgacccccgactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccagcagcagccaggacgagaagggcgtgatccagaacggcagactgatcaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacaaccagagagcctggaacatctgggaggtggaggactacggcttcggcatcttcaccaccaacatctggctgaagctgagagacagcttcacccaggtgtgcgaccacagactgatgagcgccgccatcaaggacagcaaggccgtgcacgccgacatgggctactggatcgagagcgagaagaaggagacctggaagctggccagagccagcttcatcgaggtgaagacctgcatctggcccaagagccacaccctgtggagcaacggcgtgctggagagcgagatgatcatccccaagatctacggcggccccgtgagccagcacaactacagacccggctacttcacccagaccgccggcccctggcacctgggcaagctggagctggacttcgacctgtgcgagggcaccaccgtggtggtggacgagaactgcggcaacagaggccccagcctgagaaccaccaccgtgaccggcaagaccacccacgagagatgctgcagaagctgcaccctgccccccctgagattcaagagagaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgaccatgggccagagcacctggaacgacctgatcagactgtgcaccatggtgggcgccaacgccagcgacatgatgggcatgggcaccacctacctggccctgatggccaccttcagaatgagacccatgttcgccgtgggcctgctgttcagaagactgaccagcagagagatcctgctgctgaccgtgggcctgagcctggtggccagcgtggagctgcccaacagcctggaggagctgggcgacggcctggccatgggcatcatgatgctgaagctgctgaccgacttccagccccaccagctgtgggccaccctgctgagcctgaccttcgtgaagaccaccctgagcctgcactacgcctggaagaccatggccatgatcctgagcatcgtgagcctgctgcccctgtgcctgagcaccaccagccagaagaccacctggctgcccgtgctgctgggcagcctgggctgcaagcccctgaccatgttcctgatcaccgagaacaagatctggggcagaagaagctggcccctgaacgagggcatcatggccatcggcatcgtgagcatcctgctgagcagccccctgaagaacgacgtgcccctggccggccccctgatcgccggcggcatgctgatcgcctgctacgtgatcagcggcagcagcgccgacctgagcctggagaaggccgccgaggtgagctgggaggacgaggccgagcacagcggcgccagccacaacatcctggtggaggtgcaggacgacggcaccatgaagatcaaggacgaggagagagacgacaccctgaccatcctgctgaaggccaccctgctggtgatcagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagcaccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtggtgcagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccccaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgaaggcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccacgccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagatcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcagaagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggccaccacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgttcgactggctggagaagcacggcatcgagagactgaagagaatggccatcagcggcgacgactgcgtggtgaagcccatcgacgacagattcgccaccgccctgaccgccctgaacgacatgggcaaggtgagaaaggacatcccccagtgggagccccccaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16882 - RNA, 9879 nt, synthetic construct
  misc_feature 1..9879: note = derived and/or modified CDS sequence (opt4) from DENV-1__HQ332182__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgagaatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcgccagccaggtgctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccgtgggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16883 - RNA, 9879 nt, synthetic construct
  misc_feature 1..9879: note = derived and/or modified CDS sequence (opt4) from DENV-1__HQ332181__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggtgcagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcaccggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccgccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16884 - RNA, 9879 nt, synthetic construct
  misc_feature 1..9879: note = derived and/or modified CDS sequence (opt4) from DENV-1__HQ332180__SS-prME
  source 1..9879: mol_type = other RNA
agcgtgaccatgctgctgatgctgctgcccaccgccctggccttccacctgaccaccagaggcggcgagccccacatgatcatcagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgccatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacccacctggccctgatggccaccttcaagatgagacccatgttcgccgtgggcctgctgttcagaagactgaccagcagagaggtgctgctgctgaccatcggcctgagcctgatggccagcatggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatgatcctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16885 - RNA, 9879 nt, synthetic construct
  misc_feature 1..9879: note = derived and/or modified CDS sequence (opt4) from DENV-1__HQ332179__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgctgctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggcctgcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16886 - RNA, 9879 nt, synthetic construct
  misc_feature 1..9879: note = derived and/or modified CDS sequence (opt4) from DENV-1__KR919820__SS-prME
  source 1..9879: mol_type = other RNA
accgtggtggccctgctgatgctgctgcccatggtgttcagcttccacctgaccaccagaggcggcgagccccacatgatcgtgaacaagcaggagagaggcaagagcctgctgttcaagaccagcggcggcatcaacatgtgcaccctgatcgccatggacctgggcgacctgtgcgaggacaccatgacctacaagtgccccagaatcaccgaggccgagcccgacgacgtggactgctggtgcaacgccaccgacacctgggtgacctacggcatctgcagccccaccggcgagcacagaagagagaagagaagcgtggccctggccccccacgtgggcctgggcctggagaccagagccgagacctggatgagcagcgagggcgcctggaagcagatccagagagtggagacctgggccctgagacaccccggcttcaccgtgatcgccctgttcctggcccacatcatcggcaccagcatcacccagaagggcgtgatcttcatcctgctgatgctggtgacccccagcatggccatgagatgcgtgggcgtgggcaacagagacttcgtggagggcctgagcggcgccacctgggtggacgtggtgctggagcacggcagctgcgtgaccaccatggccaagaacaagcccaccctggacatcgagctgctgaagaccgaggtgagcaaccccgccgtgctgagaaagctgtgcatcgaggccagaatcagcaacaccaccaccgacagcagatgccccacccagggcgaggccagcctgagcgaggagcaggacaccaacttcgtgtgcagaagaaccctggtggacagaggctggggcaacggctgcggcctgttcggcaagggcagcctgatcacctgcgccaagttcgagtgcctgaccaagatggagggcaagatcgtgcagtacgagaacctgaagtacagcgtgatcgtgaccgtgcacaccggcgaccagcaccaggtgggcaacgagaccaccggccacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctgggccagcggcgccagcagcccccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctgaagaaggaggtggccgagacccagcacggcaccgtgctggtgcaggtggagtacgagggcaccgacgccccctgcaagatccccttcaccacccaggacgagaagggcgtgatccagaacggcagactgatcaccgccaaccccatcgtgaccgacaaggagaagcccgtgaacatcgaggccgagccccccttcggcgagagctacatggtgatcggcgtgggcgacaaggccctgaagctgagctggttcaagaagggcagcagcctgggcaagatgttcgaggccaccgccagaggcgccagaagaatggccatcctgggcgacaccgcctgggacttcggcagcgtgggcggcgtgttcaccagcatgggcaagctggtgcaccagatcttcggcaccgcctacggcgtgctgttcagcggcgtgagctggaccatgaagatcggcatcggcctgctgctgacctggctgggcctgaacagcagaagcaccagcctgagcatgacctgcatcgccgtgggcatcatcaccctgtacctgggcgtgatggtgcaggccgacaccggctgcgtggtgaactggaagggcagagagctgaagtgcggcagcggcatcttcgtgaccaacgaggtgcacacctggaccgagcagtacaagttccaggccgacagccccaagagactgagcgccgccatcggcaaggcctgggaggacggcgtgtgcggcatcagaagcgccaccagactggagaacatcatgtggaagcagatcgccaacgagctgaactacatcctgctggagaacgacatgaagttcaccgtggtggtgggcgacgtgaagggcatcctgacccagggcaagaagggcatcagaccccagcccatggagcacaagtacagctggaagagctggggcaaggccaagatcatcggcgccgacgtgcagaacaccaccttcatcatcgacggccccgacacccccgagtgccccgacagccagagagcctggaacatctgggaggtggaggactacggcttcggcatcttcaccaccaacatctggctgaagctgagagacagctacacccaggtgtgcgaccacagactgatgagcgccgccatcaaggacagcagagccgtgcacgccgacatgggctactggatcgagagcgagaagaacgagacctggaagctgagcagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcagtgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcaaggtggacaacttcagcctgggcctgctgtgcatcagcatcatggtggaggaggtgatgagaagcagatggagcggcaagatgctgatgaccggcaccatggccgtgttcctgctgctggtgatgggccagctgacctggaacgacctgatcagagtgtgcatcatggtgggcgcccacgccctggacagcatgggcatgggcaccacctacctggccctgatggccaccttcaagatcagacccatgctggccgtgggcctgctgttcagaaagctgaccagcagagagatcctgctgctgaccatcggcctgagcctgatcacccccgtggagctgcccaacagcatcgaggagctgggcgacggcctggccatgggcatcatgatgctgaagctgctgaccgacttccagccctaccagctgtgggccaccctgctgagcctgaccttcgtgaagaccaccctgagcctgcactacgcctggaagaccgccgccatggtgctgagcatcgtgagcctgctgcccctgtgcctgagcaccaccagccagaagaccacctggctgcccatcctgctgggcagcctgggctgcaagcccctgaccatgttcctgatcagcgagaacaagatctggggcagaagaagctggcccatcaacgagggcatcatggccgtgggcatcgtgagcatcctgatgagcagcctgctgaagaacgacgtgcccctggccggccccctgatcgccggcggcatgctggtggcctgctacgtgatcagcggcagcagcgccgacctgaccctggagaagaccgccgaggtgagctgggaggaggaggccgagcacagcggcaccgcccacaacatcctggtggaggtgcaggacgacggcaccatgaagatcaaggacgaggagagagaggacaccctgaccatcctgctgaaggccgccctgctggccctgagcggcgtgtaccccatgagcatccccgccaccctgttcgtgtggtacttctggcagaagaagaagcagagaagcggcgtgctgtgggacatccccagcccccccgaggtggagaaggccgtgctggacgacggcatctacagaatcctgcagagaggcgtgttcggcagaagccaggtgggcgtgggcgtgttccaggagggcgtgttccacaccatgtggcacgtgaccagaggcgccgtgctgacctaccagggcaagagactggagcccagctgggccagcgtgaagaaggacctgatcagctacggcggcggctggagactgcagggcagctggaacgtgggcgaggaggtgcaggtgatcgccgtggagcccggcaagaaccccaagaacgtgcagaccgtgcccggcaccttcaagacccacgagggcgaggtgggcgccatcgccctggacttcaagcccggcaccagcggcagccccatcgtgaacagagacggcaaggtggtgggcctgtacggcaacggcgtggtgaccaccagcggcacctacgtgagcgccatcgcccagagcaaggtgagccaggagggccccctgcccgagatcgaggacgaggtgttcaagaagaagaacctgaccatcatggacctgcaccccggcagcggcaagaccagaagatacctgcccgccatcgtgagagagagcatcaagagaagactgagaaccctgatcctggcccccaccagagtggtggccagcgagatggccgaggccctgaagggcctgcccatcagataccagaccaccgccgtgagaaacgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgccgaggccttcccccagagcaacagcgtgatctacgacgaggagaaggacatccccgagagaagctggaacagcggctacgactggatcaccgacttccagggcaagaccgtgtggttcgtgcccagcatcaagaccggcaacgacatcgccaactgcctgagaaagaacggcaagagagtgatccagctgagcagaaagaccttcgacaccgagtaccagaagaccaagaacagcgactgggacttcgtggtgaccaccgacatcagcgagatgggcgccaacttcagagccgacagagtgatcgaccccagaagatgcctgaagcccgtgatcctgagagacggccccgagagagtgatcctggccggccccatgcccgtgaccgtggccagcgccgcccagagaagaggcagaatcggcagaaaccagagcaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcatccagtacgccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccaccacctgacccagagagcccagaacgccctggacaacctggtgatgctgcacaacagcgagcagggcggcagagcctacagacacgccatggaggagctgcccgacaccatcgagaccctgatgctgctggccatgatcgccaccctgaccggcggcgtggccctgttcttcctgagcggcaagggcctgggcaagaccagcatcggcctgctgtgcgtgatggccagcagcaccctgctgtggatggccagcgtggagccccactggatcgccgccagcatcgtgctggagttcttcctgatggtgctgctgatccccgagcccgacagacagagaaccccccaggacaaccagctggcctacgtggtgatcggcctgctggtgctgatcctgaccgtggccgccaacgagatgggcctgctggagaccaccaagaaggacctgggcatcggcagcgccgccgccgagatccagcaccacaccaccatcctggacgtggacctgcaccccgccagcgcctggaccctgtacgccgtggccaccaccgtgatcacccccatgctgagacacaccatcgagaacaccaccgccaacatgagcctgaccgccatcgccaaccaggccgccatcctgatgggcctggacaagggctggcccatcagcaagatggacatcggcgtgcccctgctggccctgggctgctacagccaggtgaaccccatgaccctgaccgccgccgtgctgatgctggtggcccactacgccatcatcggccccggcctgcaggccaaggccaccagagacgcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccttctgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcaacagaagaggcaccggcgcccagggcgagaccctgggcgagaagtggaagagacagctgaaccagctgagcaagctggagttcaacacctacaagagaagcggcatcatggaggtggacagaaccgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaaggtgctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagaaggacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccaggtgatggagatcaccgccggctggctgtggaagttcctgagcagaaagaagaagcccagaatctgcaccagagaggagttcaccagaaaggtgagaagcaacgccgccatcggcgccgtgttcgtggacgagaaccagtggaacagcgccaaggaggccgtggacgacgagagattctgggacctggtgaacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagacaacagcctgagcggcgtggagggcgagggcctgcacaagctgggctacatcctgagagacatcgccagaatccccggcggcaacatgtacgccgacgacaccgccggctgggacaccagaatcaccgaggaggacctgcagaacgaggccagagtgaccgagctgatggagcccgaccacgcccagctggccaccagcatcttcagactgacctaccagaacaaggtggtgagagtgcagagacccggcaagaacggcaccgtgatggacgtgatcagcagaagagaccagagaggcagcggccaggtgggcacctacggcctgaacaccttcaccaacatggaggcccagctgatcagacagatggagagcgagggcgtgttcagccccagcgagctggagacccccaacctggccaacagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcagaggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgaccagctgggaggacgtgccctacctgggcaagagagaggaccagtggtgcggcagcctgatcggcctgagcgccagagccacctgggccatcaacatccaggtggccatcaaccaggtgagaaagctgatcggcaacgagcactaccaggactacatgaccagcatgagaagattcaagaacgagagcgagcccgagggcgccctgtggtga

SEQ ID NO: 16887 - RNA, 9879 nt, synthetic construct
  misc_feature 1..9879: note = derived and/or modified CDS sequence (opt4) from DENV-1__DQ285561__SS-prME
  source 1..9879: mol_type = other RNA
agcgtgaccatgctgctgatgctgctgcccaccgccctgaccttccacctgaccaccagaggcggcgagccccacatgatcgtgggcaagcaggagagaggcaagagcctgctgttcaagaccagcgccggcgtgaacatgtgcaccctgatcgccatggacctgggcgagctgtgcgacgacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagatctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatcagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactggtgaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatgatcaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagagcatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgaccatgggccagctgacctggaacgacctgatcagactgtgcatcatggtgggcgccaacgccagcgacaacatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcgtgaagaccaccttcagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggagatccaggacgacggcaccatgaagatcaaggacgaggagagagacgacaccatcaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagaaggacatccccgagagaagctggaacagcggctacgactggatcaccggcttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatgagcagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcgtggaggtggacagaagcgaggccaaggagggcctgaagagaggcgagaccatcaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatgggcgcccagctgatcagacagatggagagcgagggcatcttcagccccagcgagctggagacccccaacctggccggcagagtgctggactggctggagaagcacggcatcgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16888 - RNA, 9879 nt, synthetic construct
  misc_feature 1..9879: note = derived and/or modified CDS sequence (opt4) from DENV-1__DQ285562__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacaccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgtggtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatggtggaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatcgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcacctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacgtgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacatcatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaagcaggtgagaagactgatcggcaacgagaactacctggactacatgaccagcatgaagagattcaagaacgagagcgaccccgagggcgccctgtggtga

SEQ ID NO: 16889 - RNA, 9879 nt, synthetic construct
  misc_feature 1..9879: note = derived and/or modified CDS sequence (opt4) from DENV-1__DQ285558__SS-prME
  source 1..9879: mol_type = other RNA
agcgtgaccatgctgctgatgctgctgcccaccgccctgaccttccacctgaccaccagaggcggcgagccccacatgatcgtgggcaagcaggagagaggcaagagcctgctgttcaagaccagcgccggcgtgaacatgtgcaccctgatcgccatggacctgggcgagctgtgcgacgacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatcagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactggtgaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcctgatcaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagagcatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgaccatgggccagctgacctggaacgacctgatcagactgtgcatcatggtgggcgccaacgccagcgacaacatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcgtgaagaccaccttcagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggagatccaggacgacggcaccatgaagatcaaggacgaggagagagacgacaccatcaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatgagcagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcgtggaggtggacagaagcgaggccaaggagggcctgaagagaggcgagaccatcaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatgggcgcccagctgatcagacagatggagagcgagggcatcttcagccccagcgagctggagacccccaacctggccggcagagtgctggactggctggagaagcacggcatcgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16890 - RNA, 9879 nt, synthetic construct
  misc_feature 1..9879: note = derived and/or modified CDS sequence (opt4) from DENV-1__DQ285559__SS-prME
  source 1..9879: mol_type = other RNA
agcgtgaccatgctgctgatgctgctgcccaccgccctgaccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgatcgactacggcgccctgaccctggactgcagccccagaaccggcctggacttcaacgagatggtgctgctgaccatgaagggcaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgacccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagaagctgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcctgatcgaggaggtgatgagaagcaagtggagcagaaagatgctgatgaccggcaccctggccgtgttcctgctgctgatcatgggccagctgacctggaacgacctgaccagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagccccaccagctgtggaccaccctgctgagcctgaccttcatcaagaccaccctgagcctggactacgcctggaagaccatggccatgaccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccgccatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccaagagagtgctggactggctggagaagtacggcgccgagagactgaagagaatggccatcagcggcgacgactgcgtggtgaagcccatcgacgacagattcgccaaggccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatggccagcatgaagagattcaagaacgagagcgaccccgagggcgccctgtggtga

SEQ ID NO: 16891 - RNA, 9879 nt, synthetic construct
  misc_feature 1..9879: note = derived and/or modified CDS sequence (opt4) from DENV-1__AF311956__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatcaagttcaccgtggtggtgggcaacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccatcagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacgagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatcctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacctgggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcttccccagcgagctggagagccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16892 - RNA, 9879 nt, synthetic construct
  misc_feature 1..9879: note = derived and/or modified CDS sequence (opt4) from DENV-1__AF311958__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcaccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatcaagttcaccgtggtggtgggcaacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccatcagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagtacgagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggaggagcccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacctgggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcgccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcttccccagcgagctggagagccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16893 - RNA, 9879 nt, synthetic construct
  misc_feature 1..9879: note = derived and/or modified CDS sequence (opt4) from DENV-1__AF311957__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatcaagttcaccgtggtggtgggcaacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccatcagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccaccgtgctgagcatcgtgagcctgttccccctgtgcctgagcaccaccagccagaagaccacctggctgcccgtgctgctgggcagcttcggctgcaagcccctgaccatgttcctgatcaccgagaacgagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcagcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacctgggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcttccccagcgagctggagagccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16894 - RNA, 9879 nt, synthetic construct
  misc_feature 1..9879: note = derived and/or modified CDS sequence (opt4) from DENV-1__EU280167__SS-prME
  source 1..9879: mol_type = other RNA
agcgtgaccatgctgctgaccctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccgtgacctacaagtgccccagaatcaccgaggccgagcccgacgacgtggactgctggtgcaacgccaccgacacctgggtgacctacggcacctgcagccagaccggcgagcacagaagagacatcagaagcgtggccctggccccccacgtgggcctgggcctggagaccagaaccgagacctggatgagcagcgagggcgcctggaagcagatccagagagtggacacctgcgtgctgagacaccccggcttcaccgtgatcgccctgttcctggcccacgccatcggcaccagcatcagccagaagggcatcatcttcatcctgctgatgctggtgacccccagcatgaccatgagatgcgtgggcatcggcagcagagacttcgtggagggcctgagcggcgccacctgggtggacgtggtgctggagcacggcagctgcgtgaccagcatggccaaggacaagcccaccctggacatcgagctgctgaagaccgaggtgcccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgacaagttcaagtgcgtgaccaagctggagggcaagatcatccagtacgagaacttcaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagcagagagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagaggcctgaagtgcggcagcggcatcttcgtgaccaacgaggtgcacacctggaccggccagtacaagttccaggccgacagccccaagggcctgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagaactggggcaaggccaagatcatcggcgccgacgtgcagaacagcaccttcatcatcgacggccccaacacccccgagtgcagcgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgggcaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttcagaagccaccagctgtgggccaccctgctgagcatgaccttcatcaagaccgccttcagcctgcactacgcctggaagaccatggccatggtgctgagcatcgtgagcctgttccccctgtgcctgtacaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtgcttctggcagaagaagaagcagagaagcggcgtgctgtgggacacccccagcccccccaaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagatgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcaccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatggaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaccaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagccacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggtggtgaccgccagatggctgtggagcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacaccatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgagggcgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccaacgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcgagagagaggaccagtggtgcggcagcctgatcggcctgaccgccagagccacctgggccaccaacgtgcaggtggccatcaaccaggtgagaagactgatcggcaacgagaactacagcgactacatgaccagcatgaagagattcaagaacaagagcgagcccgagggcgccctgtggtga

SEQ ID NO: 16895 - RNA, 9876 nt, synthetic construct
  misc_feature 1..9876: note = derived and/or modified CDS sequence (opt4) from DENV-2__AJ968413__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccctgatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagctggccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacgtgatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtggtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaccaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcacgccggcaagagaagcctgagaccccagcccaccgagctgagatacagctggaagacctggggcaaggccaagatcctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccaccctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcgtggtgctgctgagccagagcaccatccccgagaccatcctggagctgaccgacgccctggccctgggcatgatggtgctgaagatcgtgagaaagatggagagataccagctggccgtgaccatcaccgccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaaacggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacatccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctggggcctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16896 - RNA, 9876 nt, synthetic construct
  misc_feature 1..9876: note = derived and/or modified CDS sequence (opt4) from DENV-2__AB543624__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgatcggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccccgagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacaaccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcgcccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaacggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcaccccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagccccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaaccacacccacttctgcatcaaggtgctgaacccctacatgcccagcgtgctggagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagagactgaccgtgaccgaggaggtggccgtgcacaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 16897 - RNA, 9876 nt, synthetic construct
  misc_feature 1..9876: note = derived and/or modified CDS sequence (opt4) from DENV-2__AB189122__SS-prME
  source 1..9876: mol_type = other RNA
accgccggcgtgatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggccccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgtgggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagaacatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccaggtgtacaagaagagcggcatccaggaggtggacagaaccctggccaaggagggcatcgagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16898 - RNA, 9876 nt, synthetic construct
  misc_feature 1..9876: note = derived and/or modified CDS sequence (opt4) from DENV-2__AB189123__SS-prME
  source 1..9876: mol_type = other RNA
accgccggcgtgatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggccccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagaacatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcatcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcgagagaggcgagaccgaccaccacgccgtgagcagaggcagcgccaagctgagatgcttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaagaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgctggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16899 - RNA, 9876 nt, synthetic construct
  misc_feature 1..9876: note = derived and/or modified CDS sequence (opt4) from DENV-2__AB189124__SS-prME
  source 1..9876: mol_type = other RNA
accgccggcgtgatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggccccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagaacatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcgagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaagaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16900 - RNA, 9876 nt, synthetic construct
  misc_feature 1..9876: note = derived and/or modified CDS sequence (opt4) from DENV-2__AB122020__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16901 - RNA, 9876 nt, synthetic construct
  misc_feature 1..9876: note = derived and/or modified CDS sequence (opt4) from DENV-2__LC121816__SS-prME
  source 1..9876: mol_type = other RNA
accgtgggcatgatcatcatgctgatccccaccgccatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccgtgacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcccacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggaggtgaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagagagacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcctacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagcaccacaaccagaccctgctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccctgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgacccccctgctgctgaccagcagcagacagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccgacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcagacaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccaagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagagcatccagcacctgaccgccaccgaggagatcgccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16902 - RNA, 9876 nt, synthetic construct
  misc_feature 1..9876: note = derived and/or modified CDS sequence (opt4) from DENV-2__LC111438__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagcccccccaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagcctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaagatcagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctggccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccatgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgatggccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccaagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatcgtgaccaactacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtggagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16903 - RNA, 9876 nt, synthetic construct
  misc_feature 1..9876: note = derived and/or modified CDS sequence (opt4) from DENV-2__KF744400__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccctgatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaaggagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgacatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacgtgatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtggtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaccaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcacgccggcaagagaagcctgagaccccagcccaccgagctgagatacagctggaagacctggggcaaggccaagatcctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgccttctgcgaccccaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagctggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacaagggcgaggacggctgctggtacggcatggagatcagacccctgaaggagaaggaggagaacctggtgagcagcctggtgaccgccggccacggccagatcgacaacttcagcctgggcgtgctgggcatggccctgttcctggaggagatgctgagaaccagagtgggcatgaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaagatggagagataccagctggccgtgaccatcatggccatcctgtgcgtgcccaacagcgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccgccgacgtgagatgggaggaccaggccgagatcagcggcagcagccccatcctgagcgtgatcgtgagcgaggacggcagcatgagcatcaagaacgaggaggaggagcagatcctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaaacggcagctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgccatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcacctgcaacatcggcatcgagagcgaggtgcccaacctggacatcatcggcaagagaatcgagaagatcaagcaggagcacgagaccagctggcactacgaccaggaccacccctacaagacctgggcctaccacggcagctacgaggccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgtacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctgaccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16904 - RNA, 9876 nt, synthetic construct
  misc_feature 1..9876: note = derived and/or modified CDS sequence (opt4) from DENV-2__KF744401__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccctgatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaaggagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacgtgatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtggtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaccaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcacgccggcaagagaagcctgagaccccagcccaccgagctgagatacagctggaagacctggggcaaggccaagatcctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgccttctgcgaccccaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagctggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacaagggcgaggacggctgctggtacggcatggagatcagacccctgaaggagaaggaggagaacctggtgagcagcctggtgaccgccggccacggccagatcgacaacttcagcctgggcgtgctgggcatggccctgttcctggaggagatgctgagaaccagagtgggcatgaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaagatggagagataccagctggccgtgaccatcatggccatcctgtgcgtgcccaacagcgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccgccgacgtgagatgggaggaccaggccgagatcagcggcagcagccccatcctgagcgtgatcgtgagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaaacggcagctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgccatcgacctggaccccatcccctacgaccccaagttcgagaagcagctgggccaggtgatgctgctggtgctgtgcgtgacccaggtgctggtgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgaggccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgtacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctgaccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16905 - RNA, 9876 nt, synthetic construct
  misc_feature 1..9876: note = derived and/or modified CDS sequence (opt4) from DENV-2__KF744402__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccctgatggccgccatcctggcctacaccatcggcaccaccaacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacgtgatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctgatcctggtgggcgtggtgaccctgtacctgggcgtggtggtgcaggccgacagcggctgcgtggtgagctggagaaacaaggagctgaagtgcggcagcggcatcttcatcaccgacaacgtgcacacctggaccgagcagtacaagttccagcccgagagccccagcaagctggccagcgccatccagaaggcccaccaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcacgccggcaagagaagcctgagaccccagcccaccgagctgagatacagctggaagacctggggcagagccaagatcctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacaccatcctgctggtggccgtgagcttcgtgaccctgatcaccggcaacatgagcttcagagacctgggcagagtgatggtgatggtgggcgccaccatgaccgacaacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatcaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcatcatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaaacggcagctacgtgagcgccatcgcccagaccggcaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggaccacgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16906 - RNA, 9876 nt, synthetic construct
  misc_feature 1..9876: note = derived and/or modified CDS sequence (opt4) from DENV-2__KF744408__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccctgatggccgccatcctggcctacaccatcggcaccaccaacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctgggcttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacgtgatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtggtggtgcaggccgacagcggctgcgtggtgagctggagaaacaaggagctgaagtgcggcagcggcatcttcatcaccgacaacgtgcacacctggaccgagcagtacaagttccagcccgagagccccagcaagctggccagcgccatccagaaggcccaccaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgagatacagctggaagacctggggcaaggccaagatcctgagcaccgagagccacaaccagaccttcctgatcgacggccccgagaccgccgagtgccccaacaccaacagagcctggaacagcctggaggtggaggactacggcttcggcgtgttcaccaccaacatctggctgagactgagagagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcaagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccgccgacgtgagatgggaggaccaggccgagatcagcggcagcagccccatcctgagcatcatcatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaaacggcagctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatgatcacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16907 - RNA, 9876 nt, synthetic construct
  misc_feature 1..9876: note = derived and/or modified CDS sequence (opt4) from DENV-2__JX669476__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagagcgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagttccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaaggtggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcagagcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacgacagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 16908 - RNA, 9876 nt, synthetic construct
  misc_feature 1..9876: note = derived and/or modified CDS sequence (opt4) from DENV-2__JX475906__SS-prME
  source 1..9876: mol_type = other RNA
accgtgggcatgatcatcatgctgatccccaccgccatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccgtgacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggaggtgaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccctgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagcagacagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccaggccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagagcatccagcacctgaccgccaccgaggagatcgccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16909 - RNA, 9876 nt, synthetic construct
  misc_feature 1..9876: note = derived and/or modified CDS sequence (opt4) from DENV-2__JX669477__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacaccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcccacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcagaagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 16910 - RNA, 9876 nt, synthetic construct
  misc_feature 1..9876: note = derived and/or modified CDS sequence (opt4) from DENV-2__JX669478__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcttcggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacatcgactacatgcccagcatgaagagattcagaagagaggaggaggaggccggcgtgctgtggtga

SEQ ID NO: 16911 - RNA, 9876 nt, synthetic construct
  misc_feature 1..9876: note = derived and/or modified CDS sequence (opt4) from DENV-2__JX669480__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcgaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgtgaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacaccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16912 - RNA, 9876 nt, synthetic construct
  misc_feature 1..9876: note = derived and/or modified CDS sequence (opt4) from DENV-2__JX669483__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcgaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcaaggtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgtgaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacaccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16913 - RNA, 9876 nt, synthetic construct
  misc_feature 1..9876: note = derived and/or modified CDS sequence (opt4) from DENV-2__JX669484__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacggcacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtgatggtgatggtgggcgtggccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatgaccatcagctgcgtgcccaacgccgtgatcctgctgaacgcctggaaggtgagctgcaccatcctggccgccgtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgatcaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16914 - RNA, 9876 nt, synthetic construct
  misc_feature 1..9876: note = derived and/or modified CDS sequence (opt4) from DENV-2__JX669485__SS-prME
  source 1..9876: mol_type = other RNA
accgccggcgtgatcatcatgctgatccccaccgccatggccttccacctgaccaccagaaacggcgagccccacatgatcgtgggcaagcaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacggcacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatcgtgatggtgggcgtgaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgctgaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagctggacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16915 - RNA, 9876 nt, synthetic construct
  misc_feature 1..9876: note = derived and/or modified CDS sequence (opt4) from DENV-2__JX669486__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcgaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgtgaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccacccccgagaccatcctggagctgaccgacgccctggccctgggcatgatggtgctgaagatcgtgagaaacatggagaagtaccagctggccgtgaccatcatgaccatcctgtgcgtgcccaacgccgtgatcctgctgaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtggtggacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccgtgttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16916 - RNA, 9876 nt, synthetic construct
  misc_feature 1..9876: note = derived and/or modified CDS sequence (opt4) from DENV-2__JX669487__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcatgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgtgaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgagaatcgtgagaaacatggagaagtaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccatcagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaagcacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggccgagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16917 - RNA, 9876 nt, synthetic construct
  misc_feature 1..9876: note = derived and/or modified CDS sequence (opt4) from DENV-2__JX669488__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgccagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgagaatcgtgagaaacatggagaagtaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccatcagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaagcacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggccgagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16918 - RNA, 9876 nt, synthetic construct
  misc_feature 1..9876: note = derived and/or modified CDS sequence (opt4) from DENV-2__JX669479__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagagcgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcagagcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaaggccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 16919 - RNA, 9876 nt, synthetic construct
  misc_feature 1..9876: note = derived and/or modified CDS sequence (opt4) from DENV-2__KF744403__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccctgatggccgccatcctggcctacaccatcggcaccaccaacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacgtgatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtggtggtgcaggccgacagcggctgcgtggtgagctggagaaacaaggagctgaagtgcggcagcggcatcttcatcaccgacaacgtgcacacctggaccgagcagtacaagttccagcccgagagccccagcaagctggccagcgccatccagaaggcccaccaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcacgccggcaagagaagcctgagaccccagcccaccgagctgagatacagctggaagacctggggcaaggccaagatcctgagcaccgagagccacaaccagaccttcctgatcgacggccccgagaccgccgagtgccccaacaccaacagagcctggaacagcctggaggtggaggactacggcttcggcgtgttcaccaccaacatctggctgagactgagagagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcaagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgagcagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaagatggagagataccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccgccgacgtgagatgggaggaccaggccgagatcagcggcagcagccccatcctgagcatcatcatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaaacggcagctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagatcctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatgatcacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16920 - RNA, 9876 nt, synthetic construct
  misc_feature 1..9876: note = derived and/or modified CDS sequence (opt4) from DENV-2__KF744406__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccctgatggccgccatcctggcctacaccatcggcaccaccaacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacgtgatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtggtggtgcaggccgacagcggctgcgtggtgagctggagaaacaaggagctgaagtgcggcagcggcatcttcatcaccgacaacgtgcacacctggaccgagcagtacaagttccagcccgagagccccagcaagctggccagcgccatccagaaggcccaccaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcacgccggcaagagaagcctgagaccccagcccaccgagctgagatacagctggaagacctggggcaaggccaagatcctgagcaccgagagccacaaccagaccttcctgatcgacggccccgagaccgccgagtgccccaacaccaacagagcctggaacagcctggaggtggaggactacggcttcggcgtgttcaccaccaacatctggctgagactgagagagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcaagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgagcagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaagatggagagataccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccgccgacgtgagatgggaggaccaggccgagatcagcggcagcagccccatcctgagcatcatcatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaaacggcagctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagatcagcctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatgatcacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16921 - RNA, 9876 nt, synthetic construct
  misc_feature 1..9876: note = derived and/or modified CDS sequence (opt4) from DENV-2__KF744404__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccctgatggccgccatcctggcctacaccatcggcaccaccaacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacgtgatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtggtggtgcaggccgacagcggctgcgtggtgagctggagaaacaaggagctgaagtgcggcagcggcatcttcatcaccgacaacgtgcacacctggaccgagcagtacaagttccagcccgagagccccagcaagctggccagcgccatccagaaggcccaccaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcacgccggcaagagaagcctgagaccccagcccaccgagctgagatacagctggaagacctggggcaaggccaagatcctgagcaccgagagccacaaccagaccttcctgatcgacggccccgagaccgccgagtgccccaacaccaacagagcctggaacagcctggaggtggaggactacggcttcggcgtgttcaccaccaacatctggctgagactgagagagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcaagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgagcagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaagatggagagataccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccgccgacgtgagatgggaggaccaggccgagatcagcggcagcagccccatcctgagcatcatcatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaaacggcagctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctgcagatcagcctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatgatcacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16922 - RNA, 9876 nt, synthetic construct
  misc_feature 1..9876: note = derived and/or modified CDS sequence (opt4) from DENV-2__KF744407__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccctgatggccgccatcctggcctacaccatcggcaccaccaacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacgtgatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggccagctggaagaacaaggagctgaagtgcggcagcggcatcttcatcaccgacaacgtgcacacctggaccgagcagtacaagttccagcccgagagccccagcaagctggccagcgccatccagaaggcccaccaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcacgccggcaagagaagcctgagaccccagcccaccgagctgagatacagctggaagacctggggcaaggccaagatcctgagcaccgagagccacaaccagaccttcctgatcgacggccccgagaccgccgagtgccccaacaccaacagagcctggaacagcctggaggtggaggactacggcttcggcgtgttcaccaccaacatctggctgagactgagagagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgagcagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccgccgacgtgagatgggaggagcaggccgagatcagcggcagcagccccatcctgagcatcatcatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaaacggcagctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatgatcacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgccaccgaggagatcgccgtgcagaactggctgaccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16923 - RNA, 9876 nt, synthetic construct
  misc_feature 1..9876: note = derived and/or modified CDS sequence (opt4) from DENV-2__KF744399__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccctgatggccgccatcctggcctacaccatcggcaccaccaacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctgggcttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacgtgatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaccaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcacgccggcaagagaagcctgagaccccagcccaccgagctgagatacagctggaaggcctggggcaaggccaagatcctgagcaccgagctgcacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcaagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaagatggagagataccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccgccgacgtgagatgggaggagcaggccgagatcagcggcagcagccccatcctgagcatcatcatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagactggagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaaacggcagctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgccaccgaggagaacgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagaacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16924 - RNA, 9876 nt, synthetic construct
  misc_feature 1..9876: note = derived and/or modified CDS sequence (opt4) from DENV-2__JX286516__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcatcgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaagggcttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 16925 - RNA, 9876 nt, synthetic construct
  misc_feature 1..9876: note = derived and/or modified CDS sequence (opt4) from DENV-2__JX286518__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 16926 - RNA, 9876 nt, synthetic construct
  misc_feature 1..9876: note = derived and/or modified CDS sequence (opt4) from DENV-2__JX286519__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcatcaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcgtgcccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaagcgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 16927 - RNA, 9876 nt, synthetic construct
  misc_feature 1..9876: note = derived and/or modified CDS sequence (opt4) from DENV-2__KP188549__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatggtgatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcgagaagagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagaccgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 16928 - RNA, 9876 nt, synthetic construct
  misc_feature 1..9876: note = derived and/or modified CDS sequence (opt4) from DENV-2__KP188550__SS-prME
  source 1..9876: mol_type = other RNA
accgccggcgtgatcgtgatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcagagcccacacccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcaccatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccaagtggctgtggaaggagctgggcaaggagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagaacatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 16929 - RNA, 9876 nt, synthetic construct
  misc_feature 1..9876: note = derived and/or modified CDS sequence (opt4) from DENV-2__KP188553__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatggtgatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcgagaagagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatcccctacagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagaccgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 16930 - RNA, 9876 nt, synthetic construct
  misc_feature 1..9876: note = derived and/or modified CDS sequence (opt4) from DENV-2__KP188556__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatggtgatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcgagaagagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccccacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagaccgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 16931 - RNA, 9876 nt, synthetic construct
  misc_feature 1..9876: note = derived and/or modified CDS sequence (opt4) from DENV-2__GU369819__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgagagccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatcgaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccaggtgtacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16932 - RNA, 9876 nt, synthetic construct
  misc_feature 1..9876: note = derived and/or modified CDS sequence (opt4) from DENV-2__JX649147__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagagcgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagaaggccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaaggagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaagaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgaagaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctgatcgcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16933 - RNA, 9876 nt, synthetic construct
  misc_feature 1..9876: note = derived and/or modified CDS sequence (opt4) from DENV-2__KF704356__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaacaccggcgacggcgtgcacatgtgcaccctgatggccatgcacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacctggagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcagcatcgtgacctgcgccatgttcacctgcaagaagatcatgaagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacgtgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcgccaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagaggagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaagatggagaagtaccagctggccgtgaccatcatggccatcctgtgcgtgcccaacgccgtgatcctgcagaacacctggaaggtgagctgcaccatcctggccgtggtgagcgtgagccccctgttcctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggagcagcggccacgagtgggtgaccgacttcaagggcaagaccgtgtggttcgtgcccagcatcagagccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccaccttcgagcccgacgtggacctgggcagcggcaccagaaacatcggcatcgagagcgagatccccaacctggacatcatcggcaagagaatcgagaagatcaagcaggagtacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16934 - RNA, 9876 nt, synthetic construct
  misc_feature 1..9876: note = derived and/or modified CDS sequence (opt4) from DENV-2__KF704355__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccggcgacggcgtgaacatgtgcaccctgatggccatggacctgggcgagctgtgcgaggacaccatcacctacaagtgccccttcctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacctggagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcagcatcgtgacctgcgccatgttcacctgcaagaagatcatgaagggcaaggtggtgcagcccgagaacctggagtacaccatcgtgatcaccccccacagcggcgaggagcacgccgtgggcaacgacaccggcaagtacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacgtgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcggcaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgaccggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaagatggagaagtaccagctggccgtgaccatcatggccatcctgtgcgtgcccaacgccgtgatcctgcagaacgcctggaaggtgagctgcaccatcctggccgtggtgagcgtgagccccctgttcctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggagcagcggccacgagtgggtgaccgacttcaagggcaagaccgtgtggttcgtgcccagcatcagagccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagtacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16935 - RNA, 9876 nt, synthetic construct
  misc_feature 1..9876: note = derived and/or modified CDS sequence (opt4) from DENV-2__KF704354__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccttcctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagatcatgaagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacgtgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcgccaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagaggagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaagatggagaagtaccagctggccgtgaccatcatggccatcctgtgcgtgcccaacgccgtgatcctgcagaacacctggaaggtgagctgcaccatcctggccgtggtgagcgtgagccccctgttcctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggagactggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggagcagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggctggggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccaccttcgagcccgacgtggacctgggcagcggcaccagaaacatcggcatcgagagcgagatccccaacctggacatcatcggcaagagaatcgagaagatcaagcaggagtacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16936 - RNA, 9876 nt, synthetic construct
  misc_feature 1..9876: note = derived and/or modified CDS sequence (opt4) from DENV-2__KF704357__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccggcgacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacctggagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcagcatcgtgacctgcgccatgttcacctgcaagaagatcatgaagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacgtgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcgccaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagaggagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaagatggagaagtaccagctggccgtgaccatcatggccatcctgtgcgtgcccaacgccgtgatcctgcagaacacctggaaggtgagctgcaccatcctggccgtggtgagcgtgagccccctgttcctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggagcagcggccacgagtgggtgaccgacttcaagggcaagaccgtgtggttcgtgcccagcatcagagccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccaccttcgagcccgacgtggacctgggcagcggcaccagaaacatcggcatcgagagcgagatccccaacctggacatcatcggcaagagaatcgagaagatcaagcaggagtacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16937 - RNA, 9876 nt, synthetic construct
  misc_feature 1..9876: note = derived and/or modified CDS sequence (opt4) from DENV-2__KF704358__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaacaccggcgacggcgtgcacatgtgcaccctgatggccatgcacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacctggagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcagcatcgtgacctgcgccatgttcacctgcaagaagatcatgaagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacgtgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcgccaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgaccggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaagatggagaagtaccagctggccgtgaccatcatggccatcctgtgcgtgcccaacgccgtgatcctgcagaacacctggaaggtgagctgcaccatcctggccgtggtgagcgtgagccccctgttcctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggagcagcggccacgagtgggtgaccgacttcaagggcaagaccgtgtggttcgtgcccagcatcagagccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccaccttcgagcccgacgtggacctgggcagcggcaccagaaacatcggcatcgagagcgagatccccaacctggacatcatcggcaagagaatcgagaagatcaagcaggagtacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16938 - RNA, 9876 nt, synthetic construct
  misc_feature 1..9876: note = derived and/or modified CDS sequence (opt4) from DENV-2__KF041232__SS-prME
  source 1..9876: mol_type = other RNA
accgccggcgtgatcatcatgctgatccccaccgccatggccttccacctgaccaccagaaacggcgagccccacatgatcgtgagcaagcaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacgccaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacatccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgagcatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccacccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcgccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatcggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagggcatccagcacctgaccgccaccgaggaggtggccgtgcaggactggctggccagagtgggcagagagagactgagcagaatggccatcagcggcgacgactgcgtggtgaagcccctggacgacagattcgccaacgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccagaaacatccagaccgccatcaaccaggtgagaagcctgatcggcagcgaggagtacaccgactacatgcccagcatgaagagattcagaagagaggaggaggaggccggcgtgctgtggtga

SEQ ID NO: 16939 - RNA, 9876 nt, synthetic construct
  misc_feature 1..9876: note = derived and/or modified CDS sequence (opt4) from DENV-2__KF041233__SS-prME
  source 1..9876: mol_type = other RNA
accgccggcgtgatcatcatgctgatccccaccgccatggccttccacctgaccaccagaaacggcgagccccacatgatcgtgagcaagcaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacatccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccgccgccatccagaaggcccacgaggagggcatctgcggcatcagaagcgtgaccagactggagaacctgatgtggaagcagatcacccccgagctgaaccacatcctgagcgagaacgaggtgaagctgagcatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctgatcgccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccacccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcgccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatcggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagggcatccagcacctgaccgccaccgaggaggtggccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagaccctggtggagagctgggaggagatcccctacctgggcaagagagaggaccagtggtgcggcagcctgatcggcctgaccagcagagccacctgggccagaaacatccagaccgccatcaaccaggtgagaagcctgatcggcagcgaggagtacaccgactacatgcccagcatgaagagattcagaagagaggaggaggaggccggcgtgctgtggtga

SEQ ID NO: 16940 - RNA, 9876 nt, synthetic construct
  misc_feature 1..9876: note = derived and/or modified CDS sequence (opt4) from DENV-2__KF041234__SS-prME
  source 1..9876: mol_type = other RNA
accgccggcgtgatcatcatgctgatccccaccgccatggccttccacctgaccaccagaaacggcgagccccacatgatcgtgagcaagcaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacgccaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacatccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtgatcaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgagcatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccacccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcgccagaaaggtgagaagcaacgccgccctgggcgccatcttcaccgacgagaacaagtggaagagcgccagagaggccgtggaggacagcagattctgggagctggtggacaaggagagagacctgcacctggagggcaagtgcgagacctgcgtgtacaacatgatgggcaagagagagaagaagatcggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagggcatccagcacctgaccgccaccgaggaggtggccgtgcaggactggctggccagagtgggcagagagagactgagcagaatggccatcagcggcgacgactgcgtggtgaagcccctggacgacagattcgccaacgccctgaccgccctgaacgacatgggcaaggtgagaaaggacatccagcagtgggagcccagcagaggctggagcgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccagaaacatccagaccgccatcaaccaggtgagaagcctgatcggcagcgaggagtacaccgactacatgcccagcatgaagagattcagaagagaggaggaggaggccggcgtgctgtggtga

SEQ ID NO: 16941 - RNA, 9876 nt, synthetic construct
  misc_feature 1..9876: note = derived and/or modified CDS sequence (opt4) from DENV-2__KF041235__SS-prME
  source 1..9876: mol_type = other RNA
accgccggcgtgatcatcatgctgatccccaccgccatggccttccacctgaccaccagaaacggcgagccccacatgatcgtgagcaagcaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacatccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgagcatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccacccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcgccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatcggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagggcatccagcacctgaccgccaccgaggaggtggccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccagaaacatccagaccgccatcaaccaggtgagaagcctgatcggcagcgaggagtacaccgactacatgcccagcatgaagagattcagaagagaggaggaggaggccggcgtgctgtggtga

SEQ ID NO: 16942 - RNA, 9876 nt, synthetic construct
  misc_feature 1..9876: note = derived and/or modified CDS sequence (opt4) from DENV-2__KF041237__SS-prME
  source 1..9876: mol_type = other RNA
accgccggcgtgatcatcatgctgatccccaccgccatggccttccacctgaccaccagaaacggcgagccccacatgatcgtgagcaagcaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacatccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgagcatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccacccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcgccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatcggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagggcatccagcacctgaccgccaccgaggaggtggccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccggccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccagaaacatccagaccgccatcaaccaggtgagaagcctgatcggcagcgaggagtacaccgactacatgcccagcatgaagagattcagaagagaggaggaggaggccggcgtgctgtggtga

SEQ ID NO: 16943 - RNA, 9876 nt, synthetic construct
  misc_feature 1..9876: note = derived and/or modified CDS sequence (opt4) from DENV-2__KM217156__SS-prME
  source 1..9876: mol_type = other RNA
accgccggcgtgatcatcatgctgatccccaccgccatggccttccacctgaccaccagaaacggcgagccccacatgatcgtgagcaagcaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacgccaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacatccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaaccccctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagaatccagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcttcaccgacaacgtgcacacctggaccgagcagtacaagttccagcccgagagccccagcaagctggccagcgccatccagaaggcccacgaggagggcatctgcggcatcagaagcatcaccagactggacaacctgatgtggaagcagatcacccccgagctgaaccacatcctgagcgagaacgaggtgaagctgagcatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgcccagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccacccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccgccagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccagcagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagagtgagcctgctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgctgaccggcgccgacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgaccccgacgtggacctgggcagcggcaccagaaacatcggcatcgagagcgagacccccaacctggacatcatcggcaagagaatcgagaagatcaagcaggagcacgagaccagcagacactacgaccaggaccacccctacaagacctgggcctaccacggcagctacgagaccaagcagaccggcagcgccagcagcaccgtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcgccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatcggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcgtgcaggtgggcacctacggcctgggcaccttcaccaacatgggcgcccagctgatcagacagatggagggcgagggcgtgttcaagggcatccagcacctgaccgccaccgaggaggtggccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtggcctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccggccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccagaaacatccagaccgccatcaaccaggtgagaagcctgatcggcagcgaggagtacaccgactacatgcccagcatgaagagattcggcagagaggaggaggaggccggcgtgctgtggtga

SEQ ID NO: 16944 - RNA, 9876 nt, synthetic construct
  misc_feature 1..9876: note = derived and/or modified CDS sequence (opt4) from DENV-2__KX380809__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccgtgatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgccaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgacagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagatccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacagaaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggagagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16945 - RNA, 9876 nt, synthetic construct
  misc_feature 1..9876: note = derived and/or modified CDS sequence (opt4) from DENV-2__KX380810__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccgtgatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgccaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgacagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagatccccgccgccgacatcggcaccgtgatcgacctggaccccatcccctacgaccccaagttcgagaagcagctgggccaggtgatgctgctggtgctgtgcagcacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacagaaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggagagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccatcagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16946 - RNA, 9876 nt, synthetic construct
  misc_feature 1..9876: note = derived and/or modified CDS sequence (opt4) from DENV-2__KX380811__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaacctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagatccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16947 - RNA, 9876 nt, synthetic construct
  misc_feature 1..9876: note = derived and/or modified CDS sequence (opt4) from DENV-2__KX380813__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagagcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaaccctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaagatcagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagaaggagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccagccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16948 - RNA, 9876 nt, synthetic construct
  misc_feature 1..9876: note = derived and/or modified CDS sequence (opt4) from DENV-2__KX380814__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaaccctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaagatcagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagaaggagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccagccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16949 - RNA, 9876 nt, synthetic construct
  misc_feature 1..9876: note = derived and/or modified CDS sequence (opt4) from DENV-2__KX380807__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggccccccacgtgggcatgggcctggagaccagaaccgagacctggatgagcagcgagggcgcctggaagcacgcccagagaatcgagatctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacaacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccgtggacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagaaccgccgccggcatcatgaagatccccgccgccctgatcgtgaccgtgatcgacctggaccccatcccctacgaccccaagttcgagaagcagctgggccaggtgatgctgctggtgctgtgcagcacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaccctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgccaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16950 - RNA, 9876 nt, synthetic construct
  misc_feature 1..9876: note = derived and/or modified CDS sequence (opt4) from DENV-2__KX380815__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgagctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcttcctgaagaacgacatccccatgaccggccccctggtggccggcggcctgctgaccgtgtgctacgtgctgaccggcagaagcgccgacctggagctggagagagccgccgacatcagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagaacatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcgtgaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagatccccgccgccctgatcatgaccgtgatcgacctggaccccatcccctacgaccccaagttcgagaagcagctgggccaggtgatgctgctggtgctgtgcagcacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaaccagctgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgccaccgaggagatcgccgtgaagaactggctggtgagagtgggcagagagagactgagcagaatggccatcagcggcgacgactgcgtggtgaagcccctggacgacagattcgccaacgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16951 - RNA, 9876 nt, synthetic construct
  misc_feature 1..9876: note = derived and/or modified CDS sequence (opt4) from DENV-2__KX380816__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaaccctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaagatcagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagaaggagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggcacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccagccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16952 - RNA, 9876 nt, synthetic construct
  misc_feature 1..9876: note = derived and/or modified CDS sequence (opt4) from DENV-2__KX380817__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16953 - RNA, 9876 nt, synthetic construct
  misc_feature 1..9876: note = derived and/or modified CDS sequence (opt4) from DENV-2__KX380818__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgagctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcttcctgaagaacgacatccccatgaccggccccctggtggccggcggcctgctgaccgtgtgctacgtgctgaccggcagaagcgccgacctggagctggagagagccgccgacatcagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagaacatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcgtgaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagatccccgccgccgacatcggcagagtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaaccagctgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgccaccgaggagatcgccgtgaagaactggctggtgagagtgggcagagagagactgagcagaatggccatcagcggcgacgactgcgtggtgaagcccctggacgacagattcgccaacgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16954 - RNA, 9876 nt, synthetic construct
  misc_feature 1..9876: note = derived and/or modified CDS sequence (opt4) from DENV-2__KX380819__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccgtgatggccgccatcctggcctacaccatcggcaccacctacttccagagagtgctgatcttcatcctgctgaccgccgtggcccccagcatgaccatgagatgcatcggcatcagcaacagagacttcgtggagggcatcagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgccaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgacagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagatccccgccgccctgatcggcagagtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacagaaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggagagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccatcagcagaaccacctggagcatccacgccacccacgagtggatgaccaccgaggacatgctgaccgcctggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16955 - RNA, 9876 nt, synthetic construct
  misc_feature 1..9876: note = derived and/or modified CDS sequence (opt4) from DENV-2__KX380821__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccgtgatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgccaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaaccctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaagatcagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagaaggagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16956 - RNA, 9876 nt, synthetic construct
  misc_feature 1..9876: note = derived and/or modified CDS sequence (opt4) from DENV-2__KX380822__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccgtgatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgccaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatgaccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcaccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgacagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagatccccgccgccgacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacagaaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggagagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16957 - RNA, 9876 nt, synthetic construct
  misc_feature 1..9876: note = derived and/or modified CDS sequence (opt4) from DENV-2__KX380828__SS-prME
  source 1..9876: mol_type = other RNA
accgccggcgtgatcatcatgctgatccccaccgccatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagatgctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacaagggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatgatcctgaagatcgtgagaaacatggagaagtaccagctggccgtgaccatcatggccatcctgtgcgcccccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggagctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagaagaagaagctgaagcccagatggctggacgccagaatctacagcgaccccctggccctgaaggagttcaaggagttcgccgccggcagaaagagcctgaccatgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgtggcccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagatccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatcggcgagttcggcagagccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagagcatccagcacctgaccaccaccgaggaggtggccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcagcgaggagtacaccgactacatgcccagcatgaagagattcagaagagaggaggaggaggccggcgtgctgtggtga

SEQ ID NO: 16958 - RNA, 9876 nt, synthetic construct
  misc_feature 1..9876: note = derived and/or modified CDS sequence (opt4) from DENV-2__KX380829__SS-prME
  source 1..9876: mol_type = other RNA
accgccggcgtgatcatcatgctgatccccaccgccatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagatgctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacaagggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatgatcctgaagatcgtgagaaacatggagaagtaccagctggccgtgaccatcatggccatcctgtgcgcccccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggagctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagaagaagaagctgaagcccagatggctggacgccagaatctacagcgaccccctggccctgaaggagttcaaggagttcgccgccggcagaaagagcctgaccatgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgtggcccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtgatggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatcggcgagttcggcagagccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagagcatccagcacctgaccaccaccgaggaggtggccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcagcgaggagtacaccgactacatgcccagcatgaagagattcagaagagaggaggaggaggccggcgtgctgtggtga

SEQ ID NO: 16959 - RNA, 9876 nt, synthetic construct
  misc_feature 1..9876: note = derived and/or modified CDS sequence (opt4) from DENV-2__KX380830__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccgtgatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgccaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgacagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagatccccgccgccgacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacagaaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggagagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccatcagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16960 - RNA, 9876 nt, synthetic construct
  misc_feature 1..9876: note = derived and/or modified CDS sequence (opt4) from DENV-2__KX380831__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaacctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacaccatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16961 - RNA, 9876 nt, synthetic construct
  misc_feature 1..9876: note = derived and/or modified CDS sequence (opt4) from DENV-2__KX380808__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgaagcagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccatcgcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgagatcaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacaccgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtgacccactacgccatcatcggccccggcctgcaggccaaggccaccagagaggcccagaagagagccgccgccggcatcatgaagatccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcctgttcaagagcatccagcacctgaccgtgaccgaggagatcgccgtgaagaactggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16962 - RNA, 9876 nt, synthetic construct
  misc_feature 1..9876: note = derived and/or modified CDS sequence (opt4) from DENV-2__KX380832__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccgtgatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgccaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatgaccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcaccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgacagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagatccccgccgccgacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacagaaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggagagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16963 - RNA, 9876 nt, synthetic construct
  misc_feature 1..9876: note = derived and/or modified CDS sequence (opt4) from DENV-2__KX380833__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccgtgatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgccaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgacagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagatccccgccgccgacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacagaaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggagagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccatcagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16964 - RNA, 9876 nt, synthetic construct
  misc_feature 1..9876: note = derived and/or modified CDS sequence (opt4) from DENV-2__KX380834__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaacctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16965 - RNA, 9876 nt, synthetic construct
  misc_feature 1..9876: note = derived and/or modified CDS sequence (opt4) from DENV-2__KX380835__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccgtgatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgccaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgacagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacagaaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggagagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccatcagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16966 - RNA, 9876 nt, synthetic construct
  misc_feature 1..9876: note = derived and/or modified CDS sequence (opt4) from DENV-2__KX380836__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccgtgatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgccaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacagaaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggagagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccatcagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16967 - RNA, 9876 nt, synthetic construct
  misc_feature 1..9876: note = derived and/or modified CDS sequence (opt4) from DENV-2__KX380838__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccgtgatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgccaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccaccctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgacagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagatccccgccgccgacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacagaaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgtgaccgaggagatcgccgtgaagaactggctggagagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccatcagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16968 - RNA, 9876 nt, synthetic construct
  misc_feature 1..9876: note = derived and/or modified CDS sequence (opt4) from DENV-2__KM279515__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgccctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagacctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16969 - RNA, 9876 nt, synthetic construct
  misc_feature 1..9876: note = derived and/or modified CDS sequence (opt4) from DENV-2__KM279516__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaacatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16970 - RNA, 9876 nt, synthetic construct
  misc_feature 1..9876: note = derived and/or modified CDS sequence (opt4) from DENV-2__KM279517__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagcccccccaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16971 - RNA, 9876 nt, synthetic construct
  misc_feature 1..9876: note = derived and/or modified CDS sequence (opt4) from DENV-2__KM279518__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacagacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16972 - RNA, 9876 nt, synthetic construct
  misc_feature 1..9876: note = derived and/or modified CDS sequence (opt4) from DENV-2__KM279519__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagaaggagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggccgtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16973 - RNA, 9876 nt, synthetic construct
  misc_feature 1..9876: note = derived and/or modified CDS sequence (opt4) from DENV-2__KM279520__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccagaaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgccctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagacctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16974 - RNA, 9876 nt, synthetic construct
  misc_feature 1..9876: note = derived and/or modified CDS sequence (opt4) from DENV-2__KM279521__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagcaccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16975 - RNA, 9876 nt, synthetic construct
  misc_feature 1..9876: note = derived and/or modified CDS sequence (opt4) from DENV-2__KM279583__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggccctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16976 - RNA, 9876 nt, synthetic construct
  misc_feature 1..9876: note = derived and/or modified CDS sequence (opt4) from DENV-2__KM279585__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggacaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggaacctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16977 - RNA, 9876 nt, synthetic construct
  misc_feature 1..9876: note = derived and/or modified CDS sequence (opt4) from DENV-2__KM279525__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgatcctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaacatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16978 - RNA, 9876 nt, synthetic construct
  misc_feature 1..9876: note = derived and/or modified CDS sequence (opt4) from DENV-2__KM279528__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccaagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16979 - RNA, 9876 nt, synthetic construct
  misc_feature 1..9876: note = derived and/or modified CDS sequence (opt4) from DENV-2__KM279533__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgagaacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16980 - RNA, 9876 nt, synthetic construct
  misc_feature 1..9876: note = derived and/or modified CDS sequence (opt4) from DENV-2__KM279535__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16981 - RNA, 9876 nt, synthetic construct
  misc_feature 1..9876: note = derived and/or modified CDS sequence (opt4) from DENV-2__KM279539__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgaggagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16982 - RNA, 9876 nt, synthetic construct
  misc_feature 1..9876: note = derived and/or modified CDS sequence (opt4) from DENV-2__KM279543__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcatgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16983 - RNA, 9876 nt, synthetic construct
  misc_feature 1..9876: note = derived and/or modified CDS sequence (opt4) from DENV-2__KM279571__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaaccctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaagatcagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagaaggagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16984 - RNA, 9876 nt, synthetic construct
  misc_feature 1..9876: note = derived and/or modified CDS sequence (opt4) from DENV-2__KM279544__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcaccagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcatgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagaccctggtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16985 - RNA, 9876 nt, synthetic construct
  misc_feature 1..9876: note = derived and/or modified CDS sequence (opt4) from DENV-2__KM279549__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgtggacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16986 - RNA, 9876 nt, synthetic construct
  misc_feature 1..9876: note = derived and/or modified CDS sequence (opt4) from DENV-2__KM279552__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccacagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16987 - RNA, 9876 nt, synthetic construct
  misc_feature 1..9876: note = derived and/or modified CDS sequence (opt4) from DENV-2__KM279557__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacagcatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16988 - RNA, 9876 nt, synthetic construct
  misc_feature 1..9876: note = derived and/or modified CDS sequence (opt4) from DENV-2__KM279591__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaaccctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgtggacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16989 - RNA, 9876 nt, synthetic construct
  misc_feature 1..9876: note = derived and/or modified CDS sequence (opt4) from DENV-2__KM279558__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16990 - RNA, 9876 nt, synthetic construct
  misc_feature 1..9876: note = derived and/or modified CDS sequence (opt4) from DENV-2__KM279564__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaatcgaggaggaggaggccggcgtgctgtggtga

SEQ ID NO: 16991 - RNA, 9876 nt, synthetic construct
  misc_feature 1..9876: note = derived and/or modified CDS sequence (opt4) from DENV-2__KM279595__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaaccctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagaacatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagaaggagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaaggactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16992 - RNA, 9876 nt, synthetic construct
  misc_feature 1..9876: note = derived and/or modified CDS sequence (opt4) from DENV-2__KM279566__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaaccctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagaaggagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16993 - RNA, 9876 nt, synthetic construct
  misc_feature 1..9876: note = derived and/or modified CDS sequence (opt4) from DENV-2__KM279574__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaaccctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaagatcagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagaaggagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccagccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctggagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgaccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16994 - RNA, 9876 nt, synthetic construct
  misc_feature 1..9876: note = derived and/or modified CDS sequence (opt4) from DENV-2__KM279568__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacatcgtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16995 - RNA, 9876 nt, synthetic construct
  misc_feature 1..9876: note = derived and/or modified CDS sequence (opt4) from DENV-2__KM279569__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaaccctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagaaggagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaaggactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16996 - RNA, 9876 nt, synthetic construct
  misc_feature 1..9876: note = derived and/or modified CDS sequence (opt4) from DENV-2__KM279570__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggccgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16997 - RNA, 9876 nt, synthetic construct
  misc_feature 1..9876: note = derived and/or modified CDS sequence (opt4) from DENV-2__KM279596__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtgacccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcacctggccaccctgagaaagtactgcgtggaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgaccgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggccgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagagcatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccaagaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatgaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcagctgaccgtgaaggaggagatcgccgtgaagaactggctgatcagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactggatccccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16998 - RNA, 9876 nt, synthetic construct
  misc_feature 1..9876: note = derived and/or modified CDS sequence (opt4) from DENV-2__FJ850072__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcgaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgccctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgtggccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatgaccatcagctgcgtgcccaacgccatgatcctgctgaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgagcctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccgtgttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagaatgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 16999 - RNA, 9876 nt, synthetic construct
  misc_feature 1..9876: note = derived and/or modified CDS sequence (opt4) from DENV-2__JN819419__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcgtggaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcgtggccctgctgagccagagcaccatccccgagaccatcctggagctgaccgacgccctggccctgggcatgatggccctgaagatcgtgaagaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctggtgagctacggcggcggctggaagctggagggcgagtggaaggagggcgaggaggtgcaggtgctggccctggagcccggcaagaaccccagagccgtgcagaccaagcccggcatcttcaagaccaacaccggcaacatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgcccccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagatccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgaccagaatggccatcagcggcgacgactgcgtggtgaagcccatcgacgacagattcgccaacgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17000 - RNA, 9876 nt, synthetic construct
  misc_feature 1..9876: note = derived and/or modified CDS sequence (opt4) from DENV-2__FJ850074__SS-prME
  source 1..9876: mol_type = other RNA
accgccggcgtgatcgtgatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcgtggaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgcccaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcgtggccctgctgagccagagcaccatccccgagaccatcctggagctgaccgacgccctggccctgggcatgatggccctgaagatcgtgaagaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctggtgagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaagcaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgaccagaatggccatcagcggcgacgactgcgtggtgaagcccatcgacgacagattcgccaacgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17001 - RNA, 9876 nt, synthetic construct
  misc_feature 1..9876: note = derived and/or modified CDS sequence (opt4) from DENV-2__FJ850076__SS-prME
  source 1..9876: mol_type = other RNA
accgccggcgccatcgtgatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcgtggaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgcccaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcgtggccctgctgagccagagcaccatccccgagaccatcctggagctgaccgacgccctggccctgggcatgatggccctgaagatcgtgaagaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacgtgcccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctggtgagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaagcaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgaccagaatggccatcagcggcgacgactgcgtggtgaagcccatcgacgacagattcgccaacgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17002 - RNA, 9876 nt, synthetic construct
  misc_feature 1..9876: note = derived and/or modified CDS sequence (opt4) from DENV-2__GQ868640__SS-prME
  source 1..9876: mol_type = other RNA
accgccggcgccatcgtgatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcgtggaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgcccaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatcaccgacgacatcggcatgggcgtgacctacctggccctgctggccgccttcaaggtgagacccaccttcgccgccggcctgctgctgagaaagctgaccagcaaggagctgatgatggccaccatcggcgtggccctgctgagccagagcaccatccccgagaccatcctggagctgaccgacgccctggccctgggcatgatggccctgaagatcgtgaagaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacgtgcccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctggtgagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaagcaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgaccagaatggccatcagcggcgacgactgcgtggtgaagcccatcgacgacagattcgccaacgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17003 - RNA, 9876 nt, synthetic construct
  misc_feature 1..9876: note = derived and/or modified CDS sequence (opt4) from DENV-2__FJ850078__SS-prME
  source 1..9876: mol_type = other RNA
accgccggcgtgatcgtgatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcgtggaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcaacggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgcccaccgagagccacaaccagaccttcctgatcgacggccccgagaccgccgagtgccccaacgccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcgtggccctgctgagccagagcaccatccccgagaccatcctggagctgaccgacgccctggccctgggcatgatggccctgaagatcgtgaagaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctggtgagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaagcaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccagaggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgaccagaatggccatcagcggcgacgactgcgtggtgaagcccatcgacgacagattcgccaacgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17004 - RNA, 9876 nt, synthetic construct
  misc_feature 1..9876: note = derived and/or modified CDS sequence (opt4) from DENV-2__FJ850082__SS-prME
  source 1..9876: mol_type = other RNA
accgtgggcgtgatcgtgatgctgatccccaccgccatggccttccacctgaccaccagaaacggcgagccccacatgatcgtgggcagacaggagaagggcaagagcctgctgttcaagaccgagaacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcgtggaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccgtgaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcgtggccctgctgagccagagcaccatccccgagaccatcctggagctgaccgacgccctggccctgggcatgatggccctgaagatcgtgaagaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggagggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctggtgagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgacaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagatccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatgatcaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgaccagaatggccatcagcggcgacgactgcgtggtgaagcccatcgacgacagattcgccaacgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17005 - RNA, 9876 nt, synthetic construct
  misc_feature 1..9876: note = derived and/or modified CDS sequence (opt4) from DENV-2__FJ850085__SS-prME
  source 1..9876: mol_type = other RNA
accgtgggcgtgatcgtgatgctgatccccaccgccatggccttccacctgaccaccagaaacggcgagccccacatgatcgtgggcagacaggagaagggcaagagcctgctgttcaagaccgagaacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcgtggaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtggccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccgtgaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcgtggccctgctgagccagagcaccatccccgagaccatcctggagctgaccgacgccctggccctgggcatgatggccctgaagatcgtgaagaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggagggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctggtgagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgacaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagatccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatgatcaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgaccagaatggccatcagcggcgacgactgcgtggtgaagcccatcgacgacagattcgccaacgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17006 - RNA, 9876 nt, synthetic construct
  misc_feature 1..9876: note = derived and/or modified CDS sequence (opt4) from DENV-2__FJ850088__SS-prME
  source 1..9876: mol_type = other RNA
accgccggcgtgatcgtgatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcgtggaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggaggtgaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcaacggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgcccaccgagagccacaaccagaccttcctgatcgacggccccgagaccgccgagtgccccaacgccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcctggtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcgtggccctgctgagccagagcaccatccccgagaccatcctggagctgaccgacgccctggccctgggcatgatggccctgaaggtggtgaagaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctggtgagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaagcaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcaaggcctacaaccacgccctgagcgagctgcccgagaccctggagaccctgctgctgctggccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcgtgatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccagaggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaacctacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcagaaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgaccagaatggccatcagcggcgacgactgcgtggtgaagcccatcgacgacagattcgccaacgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17007 - RNA, 9876 nt, synthetic construct
  misc_feature 1..9876: note = derived and/or modified CDS sequence (opt4) from DENV-2__FJ850091__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagagccgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgccaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17008 - RNA, 9876 nt, synthetic construct
  misc_feature 1..9876: note = derived and/or modified CDS sequence (opt4) from DENV-2__GQ199890__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccatcggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagagagccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccaccatcaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcaccatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaaaggaggaggaggaggccggcgtgctgtggtga

SEQ ID NO: 17009 - RNA, 9876 nt, synthetic construct
  misc_feature 1..9876: note = derived and/or modified CDS sequence (opt4) from DENV-2__GQ868549__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatgggcaacgagggctacaccgactacatgcccagcatgaagagattcagaagagaggaggaggaggccggcgtgctgtggtga

SEQ ID NO: 17010 - RNA, 9876 nt, synthetic construct
  misc_feature 1..9876: note = derived and/or modified CDS sequence (opt4) from DENV-2__GQ868551__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggtgaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatgggcaacgagggctacaccgactacatgcccagcatgaagagattcagaagagaggaggaggaggccggcgtgctgtggtga

SEQ ID NO: 17011 - RNA, 9876 nt, synthetic construct
  misc_feature 1..9876: note = derived and/or modified CDS sequence (opt4) from DENV-2__HM181971__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatcgacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatgggcaacgagggctacaccgactacatgcccagcatgaagagattcagaagagaggaggaggaggccggcgtgctgtggtga

SEQ ID NO: 17012 - RNA, 9876 nt, synthetic construct
  misc_feature 1..9876: note = derived and/or modified CDS sequence (opt4) from DENV-2__GU131881__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaagaacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcaaggcctacacccacgccctgagcgagctgcccgagaccctggagaccctgctgctgctgaccctgctggccgccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccgtgttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17013 - RNA, 9876 nt, synthetic construct
  misc_feature 1..9876: note = derived and/or modified CDS sequence (opt4) from DENV-2__FJ898461__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttccagaccaccgtgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggtggtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagactgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17014 - RNA, 9876 nt, synthetic construct
  misc_feature 1..9876: note = derived and/or modified CDS sequence (opt4) from DENV-2__FJ024473__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcaccagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcgacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagatacctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagaccaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagcccccccctggtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccgtggacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgaggccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgcccagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17015 - RNA, 9876 nt, synthetic construct
  misc_feature 1..9876: note = derived and/or modified CDS sequence (opt4) from DENV-2__FJ024474__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacatcggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagatacctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgccagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagatcctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgacccacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccgtggacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgcccagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17016 - RNA, 9876 nt, synthetic construct
  misc_feature 1..9876: note = derived and/or modified CDS sequence (opt4) from DENV-2__FJ024475__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcgacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagatacctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagaccaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccgtggacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatgaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgcccagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17017 - RNA, 9867 nt, synthetic construct
  misc_feature 1..9867: note = derived and/or modified CDS sequence (opt4) from DENV-2__FJ182012__SS-prME
  source 1..9867: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagatacctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagatcctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgacccacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccgtggacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgagcctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgcccagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17018 - RNA, 9876 nt, synthetic construct
  misc_feature 1..9876: note = derived and/or modified CDS sequence (opt4) from DENV-2__EU854293__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccggcgacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagagcgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatgaagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacgaggtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaagatggagaagtaccagctggccgtgaccatcatggccatcctgtgcgtgcccaacgccgtgatcctgcagaacgcctggaaggtgagctgcaccatcctggccgtggtgagcgtgagccccctgttcctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagatcctgaccatcctgatcagaaccggcctgctggtgatcagcggcctgttccccgtgagcatgcccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggagcagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17019 - RNA, 9876 nt, synthetic construct
  misc_feature 1..9876: note = derived and/or modified CDS sequence (opt4) from DENV-2__EU854294__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagatacctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccgtggacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgcccagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17020 - RNA, 9876 nt, synthetic construct
  misc_feature 1..9876: note = derived and/or modified CDS sequence (opt4) from DENV-2__FJ024477__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgccaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggccgccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17021 - RNA, 9876 nt, synthetic construct
  misc_feature 1..9876: note = derived and/or modified CDS sequence (opt4) from DENV-2__GQ868552__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcgccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgctgcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggagaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatcgccctgttcctggaggagatgctgagaaccagagtgggcaccaagcacgccatcctgctggtggccatcagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaagactgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgctgaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccacgccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgagaacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcagagccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctgagcgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17022 - RNA, 9876 nt, synthetic construct
  misc_feature 1..9876: note = derived and/or modified CDS sequence (opt4) from DENV-2__GQ868553__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcaggtgacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgtgggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcttcgagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagatcctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcagaaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgcccagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17023 - RNA, 9876 nt, synthetic construct
  misc_feature 1..9876: note = derived and/or modified CDS sequence (opt4) from DENV-2__GQ868554__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgtggagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17024 - RNA, 9876 nt, synthetic construct
  misc_feature 1..9876: note = derived and/or modified CDS sequence (opt4) from DENV-2__GQ868555__SS-prME
  source 1..9876: mol_type = other RNA
accgccggcgtgatcgtgatgctgatccccaccgccatcgccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgaggtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggagggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatcgaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17025 - RNA, 9876 nt, synthetic construct
  misc_feature 1..9876: note = derived and/or modified CDS sequence (opt4) from DENV-2__GQ868556__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgatcgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcaccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgagaatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17026 - RNA, 9876 nt, synthetic construct
  misc_feature 1..9876: note = derived and/or modified CDS sequence (opt4) from DENV-2__GQ868557__SS-prME
  source 1..9876: mol_type = other RNA
accgccggcgtgatcgtgatgctgatccccaccgccatcgccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgaggtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagaacgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17027 - RNA, 9876 nt, synthetic construct
  misc_feature 1..9876: note = derived and/or modified CDS sequence (opt4) from DENV-2__GU131947__SS-prME
  source 1..9876: mol_type = other RNA
accgccggcgtgatcgtgatgctgatccccaccgccatcgccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccatgatcctgagaaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgaggtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcagagccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccatcgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17028 - RNA, 9876 nt, synthetic construct
  misc_feature 1..9876: note = derived and/or modified CDS sequence (opt4) from DENV-2__GQ868558__SS-prME
  source 1..9876: mol_type = other RNA
accgccggcgtgatcgtgatgctgatccccaccgccatcgccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggccggcaagagaagcctgagaccccagcccaccgagctgaagtacagctggaagacctggggcaaggccaagatgcacagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgagaaacgcctggaaggtgagctgcaccatcctggccgccgtgagcgtgagccccctgctgctgaccagcagccagcagaaggccgactggatccccctggtgctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgaggtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacgccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccatcgaggagatcgccgtgcagaactggctggccaaggtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17029 - RNA, 9876 nt, synthetic construct
  misc_feature 1..9876: note = derived and/or modified CDS sequence (opt4) from DENV-2__KJ189305__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgccagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacaccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17030 - RNA, 9876 nt, synthetic construct
  misc_feature 1..9876: note = derived and/or modified CDS sequence (opt4) from DENV-2__FJ898451__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgtgctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17031 - RNA, 9876 nt, synthetic construct
  misc_feature 1..9876: note = derived and/or modified CDS sequence (opt4) from DENV-2__HM488257__SS-prME
  source 1..9876: mol_type = other RNA
accgccggcatcatcatcatgatgatccccaccgtgatggccttccacctgaccaccagaaacggcgagccccacatgatcgtgagcagacaggagaagggcaagagcctgctgttcaagaccgagaacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgtgaccggcgagcacagaagagagaagagaagcgtggccctggtgccccacgtgggcatgggcctggagaccagaaccgagacctggatgagcagcgagggcgcctggaagcacgcccagagaatcgagacctgggtgctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaaggcctggggcaaggccaagatgctgagcaccgagctgcacaaccacaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcagactggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccacctacgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccaccctggccatggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagagtgggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcaccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccgccaacaccagaagaggcaccggcaacaccggcgagaccctgggcgagaagtggaagcacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcggcttctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaaagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcagactgacctaccagaacaaggtggtgagagtgcagagacccacccccagaggcaccgtgatggacatcatcagcagaagagaccagagaggcagcggccaggtggtgacctacggcctgaacaccttcaccaacatggaggcccagctgatcagacagatggagggcgagggcgtgttcaagagcatccagcacctgaccgccaccgaggagatcgccgtgaagacctggctggtgagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccacccacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17032 - RNA, 9876 nt, synthetic construct
  misc_feature 1..9876: note = derived and/or modified CDS sequence (opt4) from DENV-2__HQ999999__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacatccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccatcaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaaggtggtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaccaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcctgacccccatgctgagacacagcatcgagaacagcagcgtgaacgtgagcctgaccgccatcgccaaccaggccaccgtgctgatgggcctgggcaagggctggcccctgagcaagatggacatcggcgcccccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17033 - RNA, 9876 nt, synthetic construct
  misc_feature 1..9876: note = derived and/or modified CDS sequence (opt4) from DENV-2__FJ898449__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccaaggacggcaccaacatgtgcaccctgatggccatggacctgggcgagctgtgcgaggacaccatcacctacaagtgccccttcctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccatcgcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccaccctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccgtggtgatcaccccccacagcggcgaggagcacgccgtgggcaacgacaccggcaagcacggcaaggaggtgaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctggactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcaccagcgagctgaaccacatcctgagcgagaacgaggtgaagctgaccatcatgaccggcgacatcaagggcatcatgcaggtgggcaagagaagcctgagaccccagcccaccgagctgagatacagctggaagacctggggcaaggccaagatgctgagcaccgagctgcacaaccagaccttcctgatcgacggccccgagaccgccgagtgccccaacaccaacagagcctggaacagcctggaggtggaggactacggcttcggcgtgttcaccaccaacatctggctgagactgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaacaacagacccggctaccacacccagaccgccggcccctggcacctgggcaagctggagatggacttcgacttctgcgagggcaccaccgtggtggtgaccgaggagtgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgagcagcctggtgaccgccggccacggccagatcgacaacttcagcctgggcatcctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcagcatccccgagaccatcctggagctgaccgacgccctggccctgggcatgatggtgctgaagatggtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggacgaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcagaaccaacaccggcaccatcggcgccgtgagcctggacttcagccccggcaccagcggcagccccatcgtggacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagaagtacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaagaccggcaacgacatcgccgcctgcctgagaaagaacggcaagagagtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccagaaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccagcgagggcatcaactacgccgacagaagatggtgcttcgacggcaccagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtgatcatcgccatcctgaccgtggtggccgccaccatggccaacgagatgggcttcctggagaagaccaagaaggacctgggcctgggccacatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccgtgagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcgtgccccccgagagatgcgacaccctgctgtgcgacatcggcgagagcagccccaaccccaccgtggaggccggcagaaccctgagagtgctgaacctggtggagaactggctgaacaacaacacccagttctgcgtgaaggtgctgaacccctacatgcccagcgtgatcgagagaatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgaggccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccaagaaggtgagaagcaacgccgccctgggcgccatcttcaccgacgagaacaagtggaagagcgccagagaggccgtggaggacaacagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccatcgaggacctgaagaacgaggagatgatcaccaaccacatggccggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccagcgaggagatcgccgtgcaggactggctggtgagagtgggcagagagagactgagcagaatggccatcagcggcgacgactgcgtggtgaagcccctggacgacagattcgccagagccctgaccgccctgaacgacatgggcaaggtgagaaaggacatccagcagtgggagcccagcagaggctggaacgactggacccaggtgcccttctgcagccaccacttccacgagctgatcatgaaggacggcagaaccctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagccacgagtggatgaccaccgaggacatgctgaccgtgtggaacagagtgtggatcctggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17034 - RNA, 9876 nt, synthetic construct
  misc_feature 1..9876: note = derived and/or modified CDS sequence (opt4) from DENV-2__FJ906966__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccttcctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcctgaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgatcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggatcatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgcagccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaagatggagaagtaccagctggccgtgaccatcatggccatcctgtgcgtgcccaacgccgtgatcctgcagaacgcctggaaggtgagctgcaccatcctggccgtggtgagcgtgagccccctgttcctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggagcagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagacaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17035 - RNA, 9876 nt, synthetic construct
  misc_feature 1..9876: note = derived and/or modified CDS sequence (opt4) from DENV-2__FJ906968__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccttcctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatgaagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgatcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggatcatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgcagccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacgaggtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaagatggagaagtaccagctggccgtgaccatcatggccatcctgtgcgtgcccaacgccgtgatcctgcagaacgcctggaaggtgagctgcaccatcctggccgtggtgagcgtgagccccctgttcctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagatcctgaccatcctgatcagaaccggcctgctggtgatcagcggcctgttccccgtgagcatccccatcaccgccgccgcctggtgcctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggagcagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17036 - RNA, 9876 nt, synthetic construct
  misc_feature 1..9876: note = derived and/or modified CDS sequence (opt4) from DENV-2__FJ906969__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccttcctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatgaagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggatcatgaagatcctgatcggcgtgatcatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgcagccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatggtgagaaagatggagaagtaccagctggccgtgaccatcatggccatcctgtgcgtgcccaacgccgtgatcctgcagaacgcctggaaggtgagctgcaccatcctggccgtggtgagcgtgagccccctgttcctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagatcctgaccatcctgatcagaaccggcctgctggtgatcagcggcctgttccccgtgagcatccccatcaccgccgccgcctggtgcctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacgccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggagcagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17037 - RNA, 9876 nt, synthetic construct
  misc_feature 1..9876: note = derived and/or modified CDS sequence (opt4) from DENV-2__FJ898454__SS-prME
  source 1..9876: mol_type = other RNA
accgccggcgtgatcatcatgctgatccccaccgccatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcctacgaggagggcatctgcggcatcagaagcgtgaccagactggagaacctgatgtggaagcagatcacccccgagctgaaccacatcctgagcgagaacgaggccaagctgaccatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaagaacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatcaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatgatcctgaagatcgtgagaaacatggagaagtaccagctggccgtgaccatcatggccaccctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagagagacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatcggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagggcatccagcacctgaccgccaccgaggaggtggccgtgcaggactggctggccagagtgggcagagagagactgagcagaatggccatcagcggcgacgactgcgtggtgaagcccctggacgacagattcgccagcgccctgaccgccctgaacgacatgggcaagatcagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcagcgaggagtacaccgactacatgcccagcatgaagagattcagaagagaggaggaggaggccggcgtgctgtggtga

SEQ ID NO: 17038 - RNA, 9876 nt, synthetic construct
  misc_feature 1..9876: note = derived and/or modified CDS sequence (opt4) from DENV-2__JQ922551__SS-prME
  source 1..9876: mol_type = other RNA
accgtgggcatgatcatcatgctgatccccaccgccatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgaagcagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctgcaagcacgcccagagaatcgagacctggatcctgagacaccccagcttcaccatcatggccgccatcctggcctacaccatcggcaccacctacttccagagagtggtgttcctgatggtgctgaccgccgtggccctgagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgagaaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccctggtgatcaccccccacagcggcgaggagaacgccgtgggcaacgacaccggcaaccacggcaaggagatcaaggtgaccccccagagcagcatcaccgaggccgccctgaccggctacggcaccgtgaccatggagtgcagccccagaaccggcctgaacttccacgagatggtgagcctgcccatggagaacaaggcctggatggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgtggggcatcgccagaacccagcacggcaccatcgtgcacagagtgcagtacgagggcgacggcagcccctgcaagatccccctgaacatcatgggcctggagaagagacacgtgctgggcagacccatcaccgtgaaccccatcgtgaccggcaaggacagccccgtgaacatcgaggccgagccccccctgggcgacagctacatcatcatcggcgtggagcccggccaggtgaagctgacctgcagccagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccagcaccaacagagcctggaacagcctgaagggcggcgactacggcttcggcgtgttcaccaccaacatctggctgaagctgaaggagagacaggacgtgagctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacctggccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccgagcacgagcagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatgatcctgaagatcgtgagaaacatggagaagtaccagctggccgtgaccatcatggccatcctgtgcgtgcccaacgccatgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacctgctgcccggcagaagcgccgacctggagctggagagagccgccgacctgagatgggaggaccaggccgagatcagcggcagcagccccatcctgagcatcaccatcagcgaggacggcagcatgagcatcaagaaccaggaggagaagcagaccctgaccatcctgatcaagaccggcctgctggtgatcagcgagctgttccccgtgcagatccccatcaccgccgccgcctggtacctgtgggaggtgaagaagcagagagccggcgtgctgtgggacgtgcccagccccccccccgtgggcaaggccgagctggaggacggcgcctacggcatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccagacccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagaagaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgccgtggccgccaccatggccaacgagatgggcttcctggagaagaccaagaaggacttcggcctgggcagcatcgccacccagccccccgagagcaacatcctggacatcgacctgagacccgccagcgcctggaccctgtacgccgtggccaccaccttcatcaccagcatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcgtgaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaagagcgacaccagaacccaggagcccaaggagggcaccaagaagctgatgaagatcacccccaagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatgggcgccaaccacctggagggcgagcccaagaagctgtacgaggccatcttcaagctgacctaccagaacaagggcgtgagagtgcagagacccacccccagaggccccctgatggacatcatcctgagaagagaccagggcggcagcggccaggtgggcacctacggcctgaacaccttcaccaacatgggcgcccagctgatcagacagatggagggcgagggcgtgttcaagggcatccagcacctgatcgccaccgaggagatcgccgtgcaggactggctggccagagtgggcagagagagattcagcagaatggccatcagcggcgacgactgcgtggtgaagcccctggacgacagattcgccagcgccctgaccgccctgaacgacatgggcaaggagagaaaggtgctgcagcagtgggagcccagcagagagtggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagccagatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17039 - RNA, 9876 nt, synthetic construct
  misc_feature 1..9876: note = derived and/or modified CDS sequence (opt4) from DENV-2__JQ922550__SS-prME
  source 1..9876: mol_type = other RNA
accgtgggcatgatcatcatgctgatccccaccgtgatggccagccacctgaccaccagaaacggcggcccccacatgatcgtgatcggccagcagaagagaaagaccagcttcttcaagaccaagaagggccacgacatgtgcaccctgatggccatggccttcggcgagttctgcgagaacaccatcacctacaagtgccccttcctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccatcgcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccaccctgaacgaggagcaggacaagagattcgtgtgcaagcacagcatggtggacagaggctggggcaacggctgcggcctgttcggcaagggcggcatcgtgacctgcgccatgttcacctgcaagaagaacatgaagggcaagatcgtgcagcccgagaacctggagtacaccgtggtgatcaccccccacagcggcgaggagcacgccgtgggcaacgacaccggcaagcacggcaaggaggtgaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcaaggacctggagaagagacacgtgctgggcagactgatcaccgtgaaccccatcgtgaccgagaaggacagccccgtgaacatcgaggccgagccccccctgggcgacagctacatcatcatcggcgtggagcccggccagctgaagctggactggttcaagaagggcagcagcatcggccagatgttcgagaacaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcggcggctgcgagagaaagaccaagaccaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgagatacagctggaagacctggggcaaggccaagatgctgagcaccgagctgcacaaccagaccttcctgatcgacggccccgagaccgccgagtgccccaacaccaacagagcctggaacagcctggaggtggaggactacggcttcggcgtgttcaccaccaacatctggctgagactgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggggcaacggcgtgctggagagcgagatggtgatccccaagaacttcgccggccccgtgagccagcacaacaacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgcccccccccaagtacagaggcgaggacggctgctggtacggcatggagatcagacccctgaaggagaaggaggagaacctggtgagcagcctggtgaccgccggccacggccagatcgacaacttcagcctgggcatcctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgagcagccagagcagcatccccgagaccatcctggagctgaccgacgccctggccctgggcatgatggtgctgaagatggtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcggcaccagcaagagaagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggacgaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagcccccccctggtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcagaaccaacaccggcaccatcggcgccgtgagcctggacttcagccccggcaccagcggcagccccatcgtggacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaagaccggcaacgacatcgccgcctgcctgagaaagaacggcaagagagtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccctgctggagctgatcagaggcggccccatccccgtgtacctgggctacaagtggcccggcgagggcatcaactacgccgacagcagactgtgcgtgggcagaacccagaacaaccagatcctggaggagaacgtggaggtggagatctggaccaaggagggcaagggcaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtgatcatcgccatcctgaccgtggtggccgccaccatggccaacgagatgggcttcctggagaagaccaagaaggacctgggcctgggcaacatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccgtgagcaccctgtgggagggcaaccccggcagattctggaacaccaccatcctgatccagatggccaacatcctgagaggcagctacctggccggcgccggccccctgttcagcatcatggagaacaccaccggccccagaagaagaaccggccagctgggcagagagctgctgagaagatggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagagatgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaatccaggagcccaaggagggcaccaagaagctgatgaagatcatggccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctgggcgccctgaagaacgagagaaagtgcaccgagcacatggagggcgagcccagaaagcccggcagaggccacttcaagtggagaaaccagaacagagtggtgggcgtgcagggccccacccccggcggcaccgtgatggacatcatcagcagaaagaaccagagaggcagcggccaggtgggcacctacggcctgaacaccttcaccaacatggaggcccagctgatcagacagatggagggcgagggcttcttcatcgagcaccagcacctgaccgccagcgaggagaacgccgtgcaggactggctggccagagtgggcagagagaaggtgagcagaatgcccatcagcggcgacgactgcgtggtgaagcccctggacgacagattcgccagagccctgaccgccctgaacgacatgggcaaggtgagaaaggacatccagcagtgggagcccagcagaggctggaacgactggacccaggtgcccttctgcagccaccacttccacgagctgatcatgaaggacggcagaaccctggtggtgccctgcagaaaccaggacgagctgatcggcagagccagaatcagccagggcgccggctggagcttcggcgagaccgcctgcctgggcaagagctacgcccagatgtggagcctgatcaacttcagaatccccgacctgagactggccgccaacgtgatctgcagcgtggtgcccagccactgggtgcccaccagcagaaccacctggagcatccacgccaaccacgagtggatgaccaccgaggacatgctgaccgtgtggaacagagtgtggatcctggagaacccctggatggaggacaagacccccgtggagagctgggaggagatcccctacctggagaagagagaggaccagtggtgcggcagcctgatcggcctgaccccccagcccccctgggccaagaacatcgagaccgccatcaaccaggtgagaagcctgatcggcaacgaggagtacatcgactacctgcccagcatgaagagattcagaatcgaggaggaggagagcggcttcctgtggtga

SEQ ID NO: 17040 - RNA, 9876 nt, synthetic construct
  misc_feature 1..9876: note = derived and/or modified CDS sequence (opt4) from DENV-2__JQ922553__SS-prME
  source 1..9876: mol_type = other RNA
accgccggcatgatcatcatgctgatccccaccgtgatggccttccacctgaccaccagaaacgtggagccccccatgatcttcagcagacaggagaagggcaagagcttcctgttcaagaccaaggacggccacgacatgtgcaccttcatggccatggacctgggcgagctgtgcgaggacaccatcacctacaagtgccccttcctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagtgctgatcttcatcctgctgaccggcgtggcccccagcatgagaatgagatgcatcggcatcagcaacagagacttcgtggagggcgtgagcggcggcagctgggtggacatcgtgctggagcacggcagctgcgtgaccaccatggccaagaacaagcccaccctggacctggagctgatcaagaccgaggccaagcagcccgccaccctgagaaagtactgcatcgaggccaagctgaccaacaccaccaccgacagcagatgccccacccagggcgagcccaccctgaacgaggagcaggacaagagattcgtgtgcaagcacagcatggtggacagaggctggggcaacggctgcggcctgttcggcaagggcgccatcgtgacctgcgccatgttcacctgcaagaagagcatgaagggcaagatcgtgcagcccgagaacctggagtacaccgtggtgatcaccccccacagcggcgaggagtacgccgtgggcaacgacaccggcaagcacggcaaggaggtgaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctggactggttcaagaagggcagcagcatcggccagatgctggagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcaccctggagctgaaccacatcctgagcgagaacgaggtgaagctgaccatcatgaccggcgacatcaagggcatcatgcaggtgggcaagagaagcctgagaccccagcccaccgagctgagatacagctggaagacctggggcaaggccaagatgctgagcaccgagctgcacaaccagaccttcctgatcgacggccccgagaccgccgagtgccccaacgccaacagagcctggaacagcctggaggtggaggactacggcttcagaaagtacaagaccaagatctggcccaccctgaaggagtggagaaaggtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggggcaacggcgtgcaggagagcgagatggtgatccccaagaacttcgccggccccgtgagccagcacaacaacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggccggctgctggtactggatggacatcagacccctgaaggagaaggagaagaacctggtgagcagcctggtgaccgccggccacggccagatcgacaacttcagcctgagaatcctgggcatggccctgttcctggagaagatgctgatgaccagactgggcaccaagcacgccatcctgctggtggccgtgagcttcgtgaccctgatcaccagaaacatgagcttcaaggacctgggcagagtgatggtgatggtgggcgccaccatgaccgacgacatgagaatgggcgtgacctacctggccctgctgcccgccttcaaggtgagacccaccttcgccaccggcctgctgctgagaaagctgaccagcaaggagctgatgatgaccaccatcggcatcgtgctgttcagccagagcagcatccccgagaccatcctggagctgaccgacgccctggccctgggcatgatggtgctgaagatggtgagaaacatggagaagtaccagctggccgtgaccatcatggccatcctgtgcgtgcccaacgccgtgatcctgcagaacgcctggagagtgagctgcaccatcctggccgtggtgagcgtgagccccctgttcctgaccagcagcagacagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggacgaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatccagcagaagggcatcttcggctacagccagatcggcgccggcgtgtacaaggagggcaccttccccaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcgcctacgtgagcgccatcgcccagaccgagaagagcatcgaggactaccccgaggtggagatggacatcttcagaaagaagagactgaccatcatggacttccaccccggcgccggcagacagaagagatacttccccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagatcgtgtggttcgtgcccagcctgaagaccggcaagtacatcgccgcctgcctgagaaagaacggcaagagagtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccctgctggagctgatcagaggcggccccatccccgtgtacctgggctacaagtggcccggcgagggcatcaactacgccgacagcagactgtgcttcgacggcatcaagaacaaccagatcctggaggagaacgtggaggtggagatctggaccaaggagggcgagagaaaggagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaggcgccctggccagcctgatggtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgaccgtgctgctgatccccgagcccgagaagcagagaaccccccaggacaaccagctgacctacgtgatcatcgccatcctgaccgtggtggccgccaccatggccaacgagatgggcttcctggagaagaccaagaaggacctgggcctgggcaacatcgccacccagcagagctgcaagaagatcctggacatctacctgggccccgccctgccctggaagctgtacgccggcggcaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcatcggccccggcctgcaggccaagcccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccgtgagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgacgagagaaacctggtgacccccgagggcaaggtggtggacctgggctgcggcagaggcggctggagcttcttctgcggcggcctgaagaacgtgagagaggtgaaggccctgaccatcggcggccccggccacgaggagcccatcctgatgagcacctacggcagaaacctggtgagaagccagagcggcgtggtggtgttccacaccccccccgagaagtgcgacaccagcctgagagacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctggggcagccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcatcaagaaggtgagaagcaacgccgccctgggcgccatcttcaccgacgagaacaagtggaagagcgccagagaggccgtggaggacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagagaaagaccaaccacatgggcggcgagcacagaaagctggccagaggcatcttcaagatgaacctgaccaacaaggtggtgagagtgcagagacccacccccggcggcaccctgatggacatcatcagcagaaagacccagagaggcagcgagcaggtgggcacctacggcctgaccaccctgaccaacctggaggccccccccatcagacagatggagggcaagggcgtgttcaagggccaccagcacagaaccgccagcgaggagaacgccgtgcaggactggctggccagagtgggcggcgagagactgagcagactggccatcagcggcgacgactgcgtggtgaagcccctggacgacagattcgccagagccctgaccgccctgaacgacatgggcaaggtgagaaaggacatccagcagtgggagcccagcagaggctggaacgactggacccaggtgcccttctgcagccaccacttccacgagctgatcatgaaggacggcagaaccctggtggtgccctgcagaaaccaggacgagctgatcggcagagccagaatcagccagggcgccggctggagcctgagagagaccgcctgcctgggcaagttctacgcccagagatggagcctgatgtacttccacagaagagacctgagactggcccccaacgccatctgcagcgccgtgagaacccactgggtgcccaccagcagaaagacctggcccatccacgccagccacgactggatgaccaccgaggtgatgctgaccgtgtggaacaagctgtggttccaggagaacccctggatggaggacaagacccccgtgggcttctgggaggagatccccttcctggagaagggcaaggaccagtggggcggcagcctgatcggcctgaccagcagacccccctgggccaagaacttccagcccgccatcaaccaggtgagaagcctgctgtgcaacgaggagagcgccgacttcatgcccagcatgaagagattcagaagagaggaggaggaggccggcgtgctgtggtga

SEQ ID NO: 17041 - RNA, 9876 nt, synthetic construct
  misc_feature 1..9876: note = derived and/or modified CDS sequence (opt4) from DENV-2__JQ922549__SS-prME
  source 1..9876: mol_type = other RNA
accgccggcgtgatcatcatgctgatccccaccgccatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgcccccggcgaccacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcctgatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgaccaagtactgcatcgaggccaagctgaccaacaccaccaccgccagcagatgccccacccagggcgagcccagcctgaacgaggagcagcacaagagattcgtgtgcaagcacagcatggtggacagaggctggggcaacggctgcggcctgttcggcaagggcggcatcgtgacctgcgccatgttcacctgcaagaagaacatgaagggcaagatcgtgcagcccgagaacctggagtacaccatcgtggtgaccccccacagcggcgaggagaacgccgtgggcaacgacaccggcaagcacggcaaggagatcaaggtgagaccccagagcagcatcaccgaggccgagctgaccggctacggcaccgtgaccatggagtgcagccccagaaccggcttcgccttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagactggtgctgggcagactgatcaccgtgaaccccatcgtgaccgagaaggacagccccgtgaacatcgaggccgagccccccttcggcgacagctacatcatcatcggcgtggagcccggccagctgaagcccagctggttcaagaagggcagcagcatcagacagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcaccaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcggcggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttccacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctggagggcgaggagggcgacctggtgcacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcagaatgatcctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctggagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagtacgaggaggaggagcccaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggcagcagccagatcggcgccagagtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcaccgtgagcctggacttcagccccggcaccagcgagagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagccccgtgaacgtgagcctgaccgccatcgccaaccaggccaccgtgctgatgggcctgggcaagggctggcccctgagcaagatggacatcggcgtgccccccctggccatcggctgctacagccaggtgaaccccatcaccctgaccgccgccctgctgctgctggtggcccactacgccatcatcggccccggcctgcaggtgaaggccaccagagaggcccagaagagagccgccgccggcatcatgaagaaccccaccgtggacggcatcaccgtgatcgacctggaccccatcccctacgaccccaagttcgagaagcagctgggccagatcatgctgagagtgctgtgcgtgacccaggtgctgatgatgagaaccacctgggccctgtgcgaggccctgaccctggccaccggccccatcagcaccctgtgggagggcaaccccggcagactgggcaacaccaccatcgccgtgagcatggccaacatcttcagaggcagctacctggccggcgccggcctgctgttcagcatcatgaagaacaccaccaacaccagaagaggcaccagcaacctgggcgagaccctgggcgagaagtggaagaacagactgaacagcctgggcaagagcgagttccagatctacaagaagagcggcatccaggaggtggacagaaccctggccaaggagggcatcaagaagggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgaggacgtgttcttcaccccccccgagaagtgcgacaccctgctgtgcgacatcggcgagagcagccccaaccccaccgtggaggccggcagaaccctgagagtgctgaacatggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcctggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcagcagaaaggtgagaagcaacgccgccctgggcgccatcttcaccgacgagaacaagtggaagagcgccagagaggccgtggaggacggcagattctgggagctggtggacaaggagagaatcctgcacctggagggcaagtgcgagacctgcgtgtacaacatgatgggcaagagagagaagaagatcggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagggcatccagcacctgaccgccaccgaggagatcgccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccaccagaagcatccacgccagacaggagtggatgaccaccgaggtgatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcagcgaggagtacaccgactacatgcccagcatgaagagattcagaagagaggaggaggaggccggcgtgctgtggtga

SEQ ID NO: 17042 - RNA, 9876 nt, synthetic construct
  misc_feature 1..9876: note = derived and/or modified CDS sequence (opt4) from DENV-2__JQ922552__SS-prME
  source 1..9876: mol_type = other RNA
accgccggcatgatcatcatgctgatccccaccgtgatggccttccacctgaccaccagaaacggcgagccccccatgatcgtgagcagacaggagaagggcaagagcctgctgttcaagaccgaggacggcgtgaacatgtgcgccctgatggccatggacctgggcgagagatgcgaggacaccatcacctacaactgccccctgctgaaccagaacgagcccgaggacatcgactgctggtgcaacagcaccagcacctgggtgacctacggcacctgcaccaccaccggcgagctgagaagagagaagatcagcgtggccctggtgccccacgtgggcatgggcctggagaccagaaccgagacctggatgagcagcgagggcgcctggaagcacgcccagagaatcgagatctggatcctgagacaccccggcttcaccatcatggccgccatcctggcctacaccatcggcaccagccacttccagagagtgctgatcttcatcctgctgaccgccatcgcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccaccctgaacgaggagcaggacaagagattcgtgtgcaagcacagcatggtggacagaggctggggcaacggctgcggcctgttcggcaagggcggcatcgtgacctgcgccatgttcacctgcaagaagatcatgaagggcaagatcgtgcagcccgagaacctggagtacaccgtggtgatcaccccccacagcggcgaggagcacgccgtgggcaacgacaccggcaagcacggcaaggaggtgaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgctggagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgaccggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcgtgaccgacaacgtgcacacctggaccgagcagtacatgttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggtgggcaagagaagcctgagaccccagcccaccgagctgagatacagctggaagacctggggccagcccaagatgctgagccccgagctgcaccaccagaccttcctgatcgacggccccgagaccgccgagtgccccaacaccaacagaacctgggacagcctggaggtggaggactacggcttcggcgtgttcaccaccaagatctggctgagactgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcatgggcgtgctggagagcgagatggtgatccccaagaacttcgccggccccgtgagccagcacaaccacagacccggcatccccacccagaccgccggcccctggcacctgggcaagctggagatggacttcgacttctgcgagggcaccaccgtggtggtgaccgaggactgcggcaacagaggccccagcctgagaaccagcaccgccagcggcaagctgatcaccgagtggtgctgcagaagctgcaccctgccccccctgagatacagaggcgaggacggctgctggtacggcatggagatcagacccctgaaggagaaggaggagaacctggtgagcagcctggtgaccgccggccacggccagatcgacaacttcagcctgggcatcctgggcatggccctgttcctggaggagatgctgagaaccagagtgggcaccaagcacgccatcctgctggtggccgtgagcttcgtgaccctgatcaccggcaacatgagcggcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcagcatccccgagaccatcctggagctgaccgacgccctggccctgggcatgatggtgctgaagatggtgagaaacatggagaagtaccagctggccgtgaccatcatggccatcctgtgcgtgcccaacgccgtgatcctgcagaacgcctggaaggtgagctgcaccatcctggccctggtgagcgtgagccccctgttcctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggacgaccaggccgagatcagcggcagcagccccatcctgagcatcaccatcagcgaggacggcagcatgagcatcaagaacgaggaggaggagcagaccctgaccatcctgatcagaaccgagctgctggtgatcagcggcctgttccccatcagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaagaaagaagctgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaagaccggcaacgacatcgccgcctgcctgagaaagaacggcaagagagtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagaggccccgccgagggcatcaactacgccgacagaagatggtgcttcgacggcatcaagaacagccagttcctggaggagaacgtggaggtggagatctggcccagcggcggcgagagaaaggagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtgatcatcgccatcctgaccgtggtggccgccaccatggccaacgagatgggcttcctggagaagaccaagaaggacctgggcctgggcaacatcgtgacccagcagcccgagagcaacatcctggacatcgacctgagacccgccagcgcctggaccctgtacgccgccgccaccaccttcatcacccccatgctgagacacagcatcgagaacagcagcgtgaacatgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgttcctgctggtggcccactacgccatcaagggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccgtgagcaccctgtgggagggcaaccccggcagattctggaacaccaccatcgccgtgagcatggccaacatcttcagaggcagctacctggccggcagcagccaggtgtggcccagcatcaacaacctgaagggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgccccagagaggagttcaccaagaaggtgagaagcaacgccgccctgggcgccatcttcaccgacgccaccaagtggaagagcgccagagaggccgtggaggacggcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagaaagaaggagggcggcgccatgtacgccgacgacagcgccggctgggacaccagaatcaccctggaggacctgaagaacgaggagagaatcaccaaccacatggaggtggagcacaagaagctggccgtgggccacttcatcctgacctaccccaacaaggtggtgagagtgcagagacccacccccgtgggcaccgtgatggacatcatcagcagaaagagccagagaggcagcggccaggtgggcacctacggcctgaacaccttcaccaacctggagggccccagaatcagacagatggagggcgaggagagcttcaagagccaccagctgcagaccgccaccgagagaaacgccgtgcaggactggctggccagagtgggcagagagagactgagcagaatggccatcagcggcgacgactgcgtggtgaagcccctggacgacagattcgccagagccctgaccgccctgaacgacatgggcaaggtgagaaaggacatccagcagtgggagcccagcagaggctggaacgactggacccaggtgcccttctgcagccaccacttccacgagctgatcatgaaggacggcagaaccctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagccacgagtgggtggccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17043 - RNA, 9876 nt, synthetic construct
  misc_feature 1..9876: note = derived and/or modified CDS sequence (opt4) from DENV-2__GU131896__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagactgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcgtgggcaaggccctgcaccagatcttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagaccgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgacagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17044 - RNA, 9876 nt, synthetic construct
  misc_feature 1..9876: note = derived and/or modified CDS sequence (opt4) from DENV-2__GU131897__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctgatcaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgatggacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaaggaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggccgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17045 - RNA, 9876 nt, synthetic construct
  misc_feature 1..9876: note = derived and/or modified CDS sequence (opt4) from DENV-2__GQ868631__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaagggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgtggccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatggccaccatcggcatcgtgctgctgagccagagcaccatccccgagaccgtgctggagctgaccgacgccctggccctgggcatgatggccctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccatgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaaggaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggccgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17046 - RNA, 9876 nt, synthetic construct
  misc_feature 1..9876: note = derived and/or modified CDS sequence (opt4) from DENV-2__GU131899__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccgtgaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatgggcgagaccctgggcgagaagtggaagagcagactgaacgccctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17047 - RNA, 9876 nt, synthetic construct
  misc_feature 1..9876: note = derived and/or modified CDS sequence (opt4) from DENV-2__GU131900__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaaggacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaaggaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggccgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17048 - RNA, 9876 nt, synthetic construct
  misc_feature 1..9876: note = derived and/or modified CDS sequence (opt4) from DENV-2__GU131901__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaaggaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggccgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17049 - RNA, 9876 nt, synthetic construct
  misc_feature 1..9876: note = derived and/or modified CDS sequence (opt4) from DENV-2__GU131902__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcgccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaaggaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggccgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17050 - RNA, 9876 nt, synthetic construct
  misc_feature 1..9876: note = derived and/or modified CDS sequence (opt4) from DENV-2__GU131924__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcaagaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaaggaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatcgtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggccgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17051 - RNA, 9876 nt, synthetic construct
  misc_feature 1..9876: note = derived and/or modified CDS sequence (opt4) from DENV-2__GQ868638__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagactgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcgtgggcaaggccctgcaccagatcttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagaccgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgacagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagagcccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcagaaacatccagcacctgaccgccaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17052 - RNA, 9876 nt, synthetic construct
  misc_feature 1..9876: note = derived and/or modified CDS sequence (opt4) from DENV-2__GU131927__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccagaaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcgtgggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcagaagaagcctgagaccccagcccaccgagctgaagtacagctggaagacctggggcaaggccaagatgctgagcaccgagagctacaaccagaccttcctgatcgacggccccgagaccaccgagtgccccaacgccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagagcctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcaccgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacaccagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccacccagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17053 - RNA, 9876 nt, synthetic construct
  misc_feature 1..9876: note = derived and/or modified CDS sequence (opt4) from DENV-2__GU131928__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgtggccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaaggaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggccgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17054 - RNA, 9876 nt, synthetic construct
  misc_feature 1..9876: note = derived and/or modified CDS sequence (opt4) from DENV-2__GU131929__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatcagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgtggccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgttcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaaggaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggccgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17055 - RNA, 9876 nt, synthetic construct
  misc_feature 1..9876: note = derived and/or modified CDS sequence (opt4) from DENV-2__GU131930__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagagcaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagaccgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcaccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacaccggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17056 - RNA, 9876 nt, synthetic construct
  misc_feature 1..9876: note = derived and/or modified CDS sequence (opt4) from DENV-2__GU131931__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcccacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccagatcttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaaggaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggccgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17057 - RNA, 9876 nt, synthetic construct
  misc_feature 1..9876: note = derived and/or modified CDS sequence (opt4) from DENV-2__GU131932__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaaggaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggccgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17058 - RNA, 9876 nt, synthetic construct
  misc_feature 1..9876: note = derived and/or modified CDS sequence (opt4) from DENV-2__GQ199892__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcaccaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcgccccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcgtgggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcatcctgggcatggccctgttcctggaggagatgctgagaaccagagtgggcaccaagcacgccatcctgctggtggccctgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccctgcccgagaccatcctggagctgaccgacgccctggccctgggcatgatggccctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggtgggcggcagagcctacacccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacgtgggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgagggctacaccgactacatgcccagcatgaagagattcagaagagaggaggaggaggccggcgtgctgtggtga

SEQ ID NO: 17059 - RNA, 9876 nt, synthetic construct
  misc_feature 1..9876: note = derived and/or modified CDS sequence (opt4) from DENV-2__JF730044__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaaggagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcagcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatgggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccgtgaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgggcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17060 - RNA, 9876 nt, synthetic construct
  misc_feature 1..9876: note = derived and/or modified CDS sequence (opt4) from DENV-2__FJ639697__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaaggagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcagcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatgggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccgtgaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagctggacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgggcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagaaccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17061 - RNA, 9876 nt, synthetic construct
  misc_feature 1..9876: note = derived and/or modified CDS sequence (opt4) from DENV-2__FJ639698__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaaggagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcatcaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgtgttctgcgaccccaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagggcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcagcgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagaacgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccaagtggctgtggaaggagctgggcaagaagaagacccccagaatctgcaccagagaggagttcaccaagaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgtgaccgaggaggtggccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17062 - RNA, 9876 nt, synthetic construct
  misc_feature 1..9876: note = derived and/or modified CDS sequence (opt4) from DENV-2__FJ639699__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaaggagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcatcaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagggcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatgatcctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagaacgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccaagtggctgtggaaggagctgggcaagaagaagacccccagaatctgcaccagagaggagttcaccaagaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagtacctgaccgtgaccgaggaggtggccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17063 - RNA, 9876 nt, synthetic construct
  misc_feature 1..9876: note = derived and/or modified CDS sequence (opt4) from DENV-2__FJ639700__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaaggagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcatcaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggccaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagggcttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatgatcctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggtgggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagaacgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccaagtggctgtggaaggagctgggcaagaagaagacccccagaatctgcaccagagaggagttcaccaagaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcatcttcaagagcatccagtacctgaccgtgaccgaggaggtggccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17064 - RNA, 9876 nt, synthetic construct
  misc_feature 1..9876: note = derived and/or modified CDS sequence (opt4) from DENV-2__GQ868620__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagtggtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctgatcgcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacgccaacaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacgacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggtactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcatcagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcgagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17065 - RNA, 9876 nt, synthetic construct
  misc_feature 1..9876: note = derived and/or modified CDS sequence (opt4) from DENV-2__FJ639702__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaaggagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcagcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatgggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtgatcaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctactacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcctggtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcaaggaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcgtgaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcagagcctacaaccacgccctgagcgagctgcccgagaccctggagaccctgctgctgctgaccctgctggccaccgtgaccggcggcgtgttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccaggagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccgtgaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgagcctggtggagaactggctgaacaacgacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgggcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgaaggagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17066 - RNA, 9876 nt, synthetic construct
  misc_feature 1..9876: note = derived and/or modified CDS sequence (opt4) from DENV-2__GQ868621__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacatcctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcatgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcacaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17067 - RNA, 9876 nt, synthetic construct
  misc_feature 1..9876: note = derived and/or modified CDS sequence (opt4) from DENV-2__FJ639704__SS-prME
  source 1..9876: mol_type = other RNA
agcgccggcatgatcatcatgctgatccccaccgtggtggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaagaccaagatgctgagcaccgagagctacaaccagaccttcctgatcgacggccccgagaccaccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacatcagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17068 - RNA, 9876 nt, synthetic construct
  misc_feature 1..9876: note = derived and/or modified CDS sequence (opt4) from DENV-2__GQ868622__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccagacagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagaagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17069 - RNA, 9876 nt, synthetic construct
  misc_feature 1..9876: note = derived and/or modified CDS sequence (opt4) from DENV-2__FJ639705__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccagacagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgagcctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17070 - RNA, 9876 nt, synthetic construct
  misc_feature 1..9876: note = derived and/or modified CDS sequence (opt4) from DENV-2__FJ639706__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgccctgctgagccagagcaccatccccgagaccatcctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaaaggaccagagaggcagcggccaggtgggcacctacggcctgaacaccttcaccaacatggaggcccagctgatcagacagatggagggcgagggcgtgttcaagaacatccagcacctgaccgccaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17071 - RNA, 9876 nt, synthetic construct
  misc_feature 1..9876: note = derived and/or modified CDS sequence (opt4) from DENV-2__FJ639707__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacatcctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccaccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcatgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggccgccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgccaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacagcagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctggtgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17072 - RNA, 9876 nt, synthetic construct
  misc_feature 1..9876: note = derived and/or modified CDS sequence (opt4) from DENV-2__FJ639708__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacatcctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcatgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17073 - RNA, 9876 nt, synthetic construct
  misc_feature 1..9876: note = derived and/or modified CDS sequence (opt4) from DENV-2__FJ639709__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagaccaccatccccgagaccatcctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggaacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17074 - RNA, 9876 nt, synthetic construct
  misc_feature 1..9876: note = derived and/or modified CDS sequence (opt4) from DENV-2__FJ639710__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcgccatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctgatcctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcagaagaagcctgagaccccagcccaccgagctgaagtacagctggaagacctggggcaaggccaagatgctgagcaccgagagctacaaccagaccttcctgatcgacggccccgagaccaccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggagcaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtggatcaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacaccagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgaaggaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatctacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17075 - RNA, 9876 nt, synthetic construct
  misc_feature 1..9876: note = derived and/or modified CDS sequence (opt4) from DENV-2__GQ868623__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcctggccctgttcctggaggagatgctgagaaccagagtgggcaccaagcacgccatcctgctggtggccgtgagcttcgtgaccctgatcaccggcaacatgagcgtgaaggacctgggcagagtggtggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcaccaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagcacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17076 - RNA, 9876 nt, synthetic construct
  misc_feature 1..9876: note = derived and/or modified CDS sequence (opt4) from DENV-2__GQ868624__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaaggaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggccgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17077 - RNA, 9876 nt, synthetic construct
  misc_feature 1..9876: note = derived and/or modified CDS sequence (opt4) from DENV-2__FJ639717__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagagcaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagaccgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcaccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacaccggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcgtgctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggaggtggccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17078 - RNA, 9876 nt, synthetic construct
  misc_feature 1..9876: note = derived and/or modified CDS sequence (opt4) from DENV-2__FJ639718__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaaggaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacaacagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggccgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17079 - RNA, 9876 nt, synthetic construct
  misc_feature 1..9876: note = derived and/or modified CDS sequence (opt4) from DENV-2__GQ868625__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggcagaatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaaggaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggccgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17080 - RNA, 9876 nt, synthetic construct
  misc_feature 1..9876: note = derived and/or modified CDS sequence (opt4) from DENV-2__KF955401__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgtggccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgttcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaaggaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggccgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17081 - RNA, 9876 nt, synthetic construct
  misc_feature 1..9876: note = derived and/or modified CDS sequence (opt4) from DENV-2__JF730047__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagagcaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagaccgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcaccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacaccggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcatcagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17082 - RNA, 9876 nt, synthetic construct
  misc_feature 1..9876: note = derived and/or modified CDS sequence (opt4) from DENV-2__JF730048__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagagcaaggcctggctggtgcacagacagtggttcctggacctgcccctgccctggctgcccggcgccgacaagcagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagaccgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcaccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatggtgctgaagatcgtgagagacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagacagcttcccccagagcaacgcccccatcatcgacgaggagagagagatccccgagagaagctggaacaccggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagacctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgccaccgaggaggtggccgtgaagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17083 - RNA, 9876 nt, synthetic construct
  misc_feature 1..9876: note = derived and/or modified CDS sequence (opt4) from DENV-2__KF955402__SS-prME
  source 1..9876: mol_type = other RNA
agcgccggcatgatcatcatgctgatccccaccgtgatggccttccacctgaccaccagaaacggcgagccccacatgatcgtgggcatccaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccgtggcccccagcatgaccatgagatgcatcggcatcagcaacagagtgttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaaggaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagcacgccgtgggcaacgacaccggcaagcacggcatggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacaagcaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagatacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgtggccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccaggaggagggcatctgcggcatcagaagcgtgaccagactggagaacctgatgtggaagcagatcacccccgagctgaaccacatcctggccgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagctacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgccttctgcgacagcaagctgatgagcgccgccatcaaggacaacagagccgtgcacgccgacatgggctactggatcgagagcgccctgaacgacacctggaagatcgagaaggccagcttcatcgaggtgaagaactgccactggcccaagagccacaccctgtggagcaacggcgtgctggagagcgagatgatcatccccaagaacctggccggccccgtgagccagcacaactacagacccggctaccacacccagatcgccggcccctggcacctgggcaagctggagatggacttcgacttctgcgacggcaccaccgtgatcgtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagagtgggcaccaagcacgccatcctgctggtggccgtgagcttcgtgaccctgatcaccggcaacatgagcttcaaggacctgggcagagtggtggtgatggtgggcgccaccatggccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccgtgctggagctgaccgacgccctggccctgggcatgatggtgctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaagaccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccatcagcatccccatcaccgccgccgcctggtacctgtgggaggtgaagaagcagagagccggcgtgctgtgggacgtgcccagccccccccccatgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcatcgacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatcgacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaagaccagagacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaaggaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgctgcccaccgtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcgtgttcaagaacatccagcacctgaccgtgaccgaggaggccgccgtgcagaactggctggccagagtgggcagagagagactgagcagaatggccatcagcggcgacgactgcgtggtgaagcccctggacgacagattcgccaacgccctgaccgccctgaacgacatgggcaagatcagaaaggacatccagcagtgggagcccagcaagggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccaagcacgagtggatgaccaccgaggacatgctgaccgtgtggaacagagtgtggatcagagagaacccctggatggaggacaagacccccgtggagagctgggaggagatcccctacctgggcaagagagaggaccagtggtgcggcagcctgatcggcctgaccagcagagccacctgggccaagaacatccaggccgccatcaaccaggtgagaagcctgatcggcaacgaggagtacaccgactacatgcccagcatgaagagattcagaagagaggaggaggaggccggcgtgctgtggtga

SEQ ID NO: 17084 - RNA, 9876 nt, synthetic construct
  misc_feature 1..9876: note = derived and/or modified CDS sequence (opt4) from DENV-2__FJ898460__SS-prME
  source 1..9876: mol_type = other RNA
accgccggcgtgatcgtgatgctgatccccaccgccatcgccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcaacggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcagcaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagagcttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatgcccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccgtgcccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17085 - RNA, 9876 nt, synthetic construct
  misc_feature 1..9876: note = derived and/or modified CDS sequence (opt4) from DENV-2__FJ882602__SS-prME
  source 1..9876: mol_type = other RNA
accgccggcatgatcatcatgctgatccccaccgccatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtggccctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgacgacggctgctggtacggcatggagatcagacccctgaaggagaaggaggagaacctggtgaacagcctggtgaccgccggctacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtggtggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagagaagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagacgtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgaggaggtgttcaagggcatccagcacctgaccgccaccgaggagatcgccgtgcagaactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17086 - RNA, 9876 nt, synthetic construct
  misc_feature 1..9876: note = derived and/or modified CDS sequence (opt4) from DENV-2__GQ252676__SS-prME
  source 1..9876: mol_type = other RNA
accgccggcgtgatcatcatgctgatccccaccgccatggccttccacctgaccaccagaaacggcgagccccacatgatcgtgagcaagcaggagaagggcaagagcctgctgttcaagaccgaggagggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacatccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgagcatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcgccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatcggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagggcatccagcacctgaccgccaccgaggaggtggccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcagcgaggagtacaccgactacatgcccagcatgaagagattcagaagagaggaggaggaggccggcgtgctgtggtga

SEQ ID NO: 17087 - RNA, 9876 nt, synthetic construct
  misc_feature 1..9876: note = derived and/or modified CDS sequence (opt4) from DENV-2__GQ252677__SS-prME
  source 1..9876: mol_type = other RNA
accgccggcgtgatcatcatgctgatccccaccgccatggccttccacctgaccaccagaaacggcgagccccacatgatcgtgagcaagcaggagaagggcaagagcctgctgttcaagaccgaggagggcgtgaacatgtgcaccctgatggccatggacctgggcgagctgtgcgaggacaccatcacctacaactgccccctgctgagacagaacgagcccgaggacatcgactgctggtgcaacagcaccagcacctgggtgacctacggcacctgcaccgccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacctacttccagagagtgctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgccagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtggtgaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacatccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtggtgagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgtgatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgagcatcatgaccggcgacatcaagggcatcatgcaggccggcaagagaagcctgagaccccagcccaccgagctgaagtacagctggaagacctggggcaaggccaagatgctgagcaccgagccccacaaccagaccttcctgatcgacggccccgagaccgccgagtgccccaacaccaacagagcctggaacagcctggaggtggaggactacggcttcggcgtgttcaccaccaacatctggctgaagctgaaggagagacaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagagtgggcaccaagcacgccgtgctgctggtggccgtgagcttcatgaccctgatcaccggcaacatgagcttcagagacctgggcagagtgatggtgatggtgggcgccgccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcaccatccccgagaccatcctggagctgaccgacgccctggccctgggcatgatgatcctgaagatcgtgagaaacatggagaagtaccagctggccgtgaccatcatggccatcctgtgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccaacaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgagatgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgagaaaggacctgatcagctacggcggcggctggaagctggagggcgagtggaaggagggcgaggaggtgcaggtgctggccctggagcccggcaagaaccccagagccgtgcagaccaagcccggcctgttcaagaccaacaccggcaccatcggcgccgtgagcctggacttcagccccggcaccagcggcagccccatcgtggacaagaagggcaaggtggtgggcctgtacggcaacggcgtggtgaccagaagcggcacctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacatcaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacagagtggccgccgagggcatcaactacgccgacagaagatggtgcttcgacggcatcaagaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacttcggcctgggcagcatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacaccggcgagaccctgggcgagaagtggaagaacagactgaacagcctgggcaagagcgagttccagatctacaagagaagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccgtggaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtgatccccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgagaaagaagaagacccccagaatgtgcaccagagaggagttcgccagaaaggtgagaagcaacgccgccctgggcgccatcttcaccgacgagaacaagtggaagagcgccagagaggccgtggaggacagcagattctgggagctggtggacaaggagagaaacctgcacctggagggcaagtgcgagacctgcgtgtacaacatgatgggcaagagagagaagaagatcggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccctggaggacctgaagaacgaggagatggtgaccaaccacatggagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatgggcgcccagctgatcagacagatggagggcgagggcgtgttcaagggcatccagcacctgaccgccaccgaggaggtggccgtgcaggactggctggccagagtgggcagagagagactgagcagaatggccatcagcggcgacgactgcgtggtgaagcccctggacgacagattcgccagcgccctgaccgccctgaacgacatgggcaaggtgagaaaggacatccagcagtgggagcccagcagaggctggaacgactggacccaggtgcccttctgcagccaccacttccacgagctgatcatgaaggacggcagagtgctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagacacgagtggatgaccaccgaggacatgctgaccgtgtggaacagagtgtggatccaggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcagcgaggagtacaccgactacatgcccagcatgaagagattcagaagagaggaggaggaggccggcgtgctgtggtga

SEQ ID NO: 17088 - RNA, 9876 nt, synthetic construct
  misc_feature 1..9876: note = derived and/or modified CDS sequence (opt4) from DENV-2__FJ898438__SS-prME
  source 1..9876: mol_type = other RNA
accgtgggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcagcaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacttcgagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacagcaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgccagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17089 - RNA, 9876 nt, synthetic construct
  misc_feature 1..9876: note = derived and/or modified CDS sequence (opt4) from DENV-2__GQ199893__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagaaggccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatcgaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccaggtgtacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17090 - RNA, 9876 nt, synthetic construct
  misc_feature 1..9876: note = derived and/or modified CDS sequence (opt4) from DENV-2__GQ199894__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagaaggccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagcacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgccagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatcgaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccaggtgtacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17091 - RNA, 9876 nt, synthetic construct
  misc_feature 1..9876: note = derived and/or modified CDS sequence (opt4) from DENV-2__FJ898439__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcagcaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccaggtggacaacttcagcctgggcgtgctgggcatggccctgttcctggaggagatgctgagaaccagaatcggcaccaagcacgccatcctgctggtggccgccagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgagaccggcggcaaggcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcttcggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcgtgggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagagaaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggaggtggccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17092 - RNA, 9876 nt, synthetic construct
  misc_feature 1..9876: note = derived and/or modified CDS sequence (opt4) from DENV-2__GQ868588__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccaaggacggcaccaacatgtgcaccctgatggccctggacctgggcgagctgtgcgaggacaccatcacctacaagtgccccttcctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccatcgcccccagcatggccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccaccctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccgtggtgatcaccccccacagcggcgaggagcacgccgtgggcaacgacaccggcaagcacggcaaggaggtgaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctggactggttcagaaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcaccagcgagctgaaccacatcctgagcgagaacgaggtgaagctgaccatcatgaccggcgacatcaagggcatcatgcaggtgggcaagagaagcctgagaccccagcccaccgagctgagatacagctggaagacctggggcaaggccaagatgctgagcaccgagctgcacaaccagaccttcctgatcgacggccccgagaccgccgagtgccccaacaccaacagagcctggaacagcctggaggtggaggactacggcttcggcgtgttcaccaccaacatctggctgagactgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatggtgatccccaagaacttcgccggccccgtgagccagcacaacaacagacccggctaccacacccagaccgccggcccctggcacctgggcaagctggagatggacttcgacttctgcgagggcaccaccgtggtggtgaccgaggagtgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgagcagcctggtgaccgccggccacggccagatcgacaacttcagcctgggcatcctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatgaccaccatcggcatcgtgctgctgagccagagcagcatccccgagaccatcctggagctgaccgacgccctggccctgggcatgatggtgctgaagatggtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccaccgacgtgaagtgggacgaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacatccccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcagaaccaacaccggcaccatcggcgccgtgagcctggacttcagccccggcaccagcggcagccccatcgtggacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagaagtacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaagaccggcaacgacatcgccgcctgcctgagaaagaacggcaagagagtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccagaaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccagcgagggcatcaactacgccgacagaagatggtgcttcgacggcaccagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtgatcatcgccatcctgaccgtggtggccgccaccatggccaacgagatgggcttcctggagaagaccaagaaggacctgggcctgggccacatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccgtgagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcgtgccccccgagaagtgcgacaccctgctgtgcgacatcggcgagagcagccccaaccccaccgtggaggccggcagaaccctgagagtgctgaacctggtggagaactggctgaacaacaacacccagttctgcgtgaaggtgctgaacccctacatgcccagcgtgatcgagagaatggagaccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgaggccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacaacagattctgggagctggtggacaaggagagaaacctgcacctggagggcaagtgcgagacctgcatctacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccatcgaggacctgaagaacgaggagatgatcaccaaccacatggccggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccagcgaggagatcgccgtgcaggactggctggtgagagtgggcagagagagactgagcagaatggccatcagcggcgacgactgcgtggtgaagcccctggacgacagattcgccagagccctgaccgccctgaacgacatgggcaaggtgagaaaggacatccagcagtgggagcccagcagaggctggaacgactggacccaggtgcccttctgcagccaccacttccacgagctgatcatgaaggacggcagaatcctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagccacgagtggatgaccaccgaggacatgctgaccgtgtggaacagagtgtggatcctggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17093 - RNA, 9876 nt, synthetic construct
  misc_feature 1..9876: note = derived and/or modified CDS sequence (opt4) from DENV-2__GQ868590__SS-prME
  source 1..9876: mol_type = other RNA
accgccggcatgatcatcatgctgatccccaccgtgatggccttccacctgaccaccagaaacggcgagccccacatgatcgtgagcagacaggagaagggcaagagcctgctgttcaagaccaaggacggcaccaacatgtgcaccctgatggccatggacctgggcgagctgtgcgaggacaccatcacctacaagtgccccttcctgaagcagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgcccagagaatcgagacctggatcctgagacaccccggcttcaccatcatggccgccatcctggcctacaccatcggcaccacccacttccagagagtgctgatcttcatcctgctgaccgccatcgcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgacagcagatgccccacccagggcgagcccaccctgaacgaggagcaggacaagagattcgtgtgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccgtggtgatcaccccccacagcggcgaggagcacgccgtgggcaacgacaccggcaagcacggcaaggaggtgaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctggactggttcaagaagggcagcagcatcggccagatgttcgagaccaccatgagaggcgccaagagaatggccatcctgggcgacaccgcctgggacttcggcagcctgggcggcatgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcatcgtgaccctgtacctgggcgtgatggtgcaggccgacagcggctgcgtggtgagctggaagaacaaggagctgaagtgcggcagcggcatcttcgtgaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacaccaagggcatcatgcaggtgggcaagagaagcctgagaccccagcccaccgagctgagatacagctggaagacctggggcaaggccaagatgctgcccaccgagctgcacaaccagaccttcctgatcgacggccccgagaccgccgagtgccccaacaccaacagagcctggaacagcctggaggtggaggactacggcttcggcgtgttcaccaccaacatctggctgagactgagagagaagcaggacgtgttctgcgacagcaagctgatgagcgccgccatcaaggacaacagagccgtgcacgccgacatgggctactggatcgagagcgccctgaacgacacctggaagatcgagaaggccagcttcatcgaggtgaagagctgccactggcccaagagccacaccctgtggagcaacggcgtgctggagagcgagatggtgatccccaagaacctggccggccccgtgagccagcacaacaacagacccggctaccacacccagaccgccggcccctggcacctgggcaagctggagatggacttcaacttctgcgagggcaccaccgtggtggtgaccgaggagtgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgagcagcctggtgaccgccggccacggccagatcgacaacttcagcctgggcatcctgggcatggccctgttcctggaggagatgctgagaaccagagtgggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgcctacaaggtgagacccaccttcgccgccggcctgctgctgagaaagctgaccagcaaggagctgatgatgaccaccatcggcatcgtgctgctgagccagagcagcatccccgagaccatcctggagctgaccgacgccctggccctgggcatgatggtgctgaagatggtgagaaacatggagaagtaccagctggccgtgaccatcatggccatcctgtgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagaaggccaccgacgtgaagtgggacgaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcctgttccccgtgagcatccccatcaccgccgccgcctggtacctgtgggaggtgaagaagcagagagccggcgtgctgtgggacgtgcccagccccccccccgtgggcaaggccgagctggaggacggcgcctacagaatcaagcagaagggcatcctgggctacagccagatcggcgccggcgtgtacaaggagggcaccttccacaccatgtggcacgtgaccagaggcgccgtgctgatgcacaagggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcctgttcagaaccaacaccggcaccatcggcgccgtgagcctggacttcagccccggcaccagcggcagccccatcgtggacaagaagggcaaggtggtgggcctgtacggcaacggcgtggtgaccagaagcggcgcctacgtgagcgccatcgcccagaccgagaagagcatcgaggacaaccccgagatcgaggacgacatcttcagaaagagaagactgaccatcatggacctgcaccccggcgccggcaagaccaagaagtacctgcccgccatcgtgagagaggccatcaagagaggcctgagaaccctgatcctggcccccaccagagtggtggccgccgagatggaggaggccctgagaggcctgcccatcagataccagacccccgccatcagagccgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaagaccggcaacgacatcgccgcctgcctgagaaagaacggcaagagagtgatccagctgagcagaaagaccttcgacagcgagtacgtgaagaccagaaccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccagaaacgagaacgaccagtacatctacatgggcgagcccctggagaacgacgaggactgcgcccactggaaggaggccaagatgctgctggacaacatcaacacccccgagggcatcatccccagcatgttcggccccgagagagagaaggtggacgccatcgacggcgagtacagactgagaggcgaggccagaaagaccttcgtggagctgatgagaagaggcgacctgcccgtgtggctggcctacaaggtggccagcgagggcatcaactacgccgacagaagatggtgcttcgacggcaccagaaacaaccagatcctggaggagaacgtggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagagacgccctggacaacctggccgtgctgcacaccgccgaggccggcggcaaggcctacaaccacgccctgagcgagctgcccgagaccctggagaccctgctgctgctgaccctgctggccaccgtgaccggcggcatcttcctgttcctgatgagcggcagaggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtgatcatcgccatcctgaccgtggtggccgccaccatggccaacgagatgggcttcctggagaagaccaagaaggacctgggcctgggccacatcgccacccagcagcccgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctggtgctgtgcgtgacccaggtgctgatgatgagaaccacctgggccctgtgcgaggccctgaccctggccaccggccccgtgagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacctggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcatcccccccgagaagtgcgacaccctgctgtgcgacatcggcgagagcagccccaaccccaccgtggaggccggcagaaccctgagagtgctgaacctggtggagagctggctgaacaacaacacccagttctgcgtgaaggtgctgaacccctacatgcccagcgtgatcgagagaatggagaccctgcagagaaagtacggcggcgccctggtgagaaaccccctgagcagaaacagcacccacgagatgtactgggtgagcaacgccagcggcaacgtggtgagcagcgtgaacatgatcagcagaatgctgatcaacagattcaccatgagacacaagaaggccacctacgagcccgacgtggacctgggcagcggcaccagaaacatcggcatcgagagcgagacccccaacctggacatcatcggcaagagaatcgagaagatcaagcaggagcacgaggccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacaacagattctgggagctggtggacaaggagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacaagctgggctacatcctgagagaggtgagcaagaaggagggcggcgccatgtacgccgacgacaccgccggctgggacaccagaatcaccatcgaggacctgaagaacgaggagatgatcaccaaccacatggccggcgagcacaagaagctggccgaggccatcttcaagctgacctaccagaacaaggtggtgagagtgcagagacccacccccatcggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccagcgaggagatcgccgtgcaggactggctggtgagagtgggcagagagagactgagcagaatggccatcagcggcgacgactgcgtggtgaagcccctggacgacagattcgccagagccctgaccgccctgaacgacatgggcaaggtgagaaaggacatccagcagtgggagcccagcagaggctggaacgactggacccaggtgcccttctgcagccaccacttccacgagctgatcatgaaggacggcagaaccctggtggtgccctgcagaaaccaggacgagctgatcggcagagccagaatcagccagggcgccggctggagcctgagagagaccgcctgcctgggcaagagctacgcccagatgtggagcctgatgtacttccacagaagagacctgagactggccgccaacgccatctgcagcgccgtgcccagccactgggtgcccaccagcagaaccacctggagcatccacgccagccacgagtggatgaccaccgaggacatgctgaccgtgtggaacagagtgtggatcctggagaacccctggatggaggacaagacccccgtggagagctgggaggagatcccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17094 - RNA, 9876 nt, synthetic construct
  misc_feature 1..9876: note = derived and/or modified CDS sequence (opt4) from DENV-2__GQ868497__SS-prME
  source 1..9876: mol_type = other RNA
accgccagcgtgatcgtgatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcagcaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtgatgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgccagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcgtgaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcatcgacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagagagagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17095 - RNA, 9876 nt, synthetic construct
  misc_feature 1..9876: note = derived and/or modified CDS sequence (opt4) from DENV-2__GU131959__SS-prME
  source 1..9876: mol_type = other RNA
accgccggcgtgatcgtgatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcagcaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacaccagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgagacctggaagatggagaaggccagcttcatcgaggtgaagagctgctactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgccagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcatcgacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17096 - RNA, 9876 nt, synthetic construct
  misc_feature 1..9876: note = derived and/or modified CDS sequence (opt4) from DENV-2__GQ868515__SS-prME
  source 1..9876: mol_type = other RNA
accgccggcgtgatcgtgatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctggatcacctacggcacctgcagcaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgagatacgagggcgacggcagcccctgcaagatccccttcgagatcaccgacagcgagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgatcctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgccagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagagcatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcatcgacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagaacatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17097 - RNA, 9876 nt, synthetic construct
  misc_feature 1..9876: note = derived and/or modified CDS sequence (opt4) from DENV-2__GQ868516__SS-prME
  source 1..9876: mol_type = other RNA
accgccggcgtgatcgtgatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctggatcacctacggcacctgcagcaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgatcctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgccagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagagcatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcatcgacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagaacatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17098 - RNA, 9876 nt, synthetic construct
  misc_feature 1..9876: note = derived and/or modified CDS sequence (opt4) from DENV-2__GU131975__SS-prME
  source 1..9876: mol_type = other RNA
accgccggcgtgatcgtgatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctggatcacctacggcacctgcagcaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgatcctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgccagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagagcatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcatcgacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaagcctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagaacatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17099 - RNA, 9876 nt, synthetic construct
  misc_feature 1..9876: note = derived and/or modified CDS sequence (opt4) from DENV-2__JN819422__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagaaggccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagacccagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatcgaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcgtgggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccaggtgtacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17100 - RNA, 9876 nt, synthetic construct
  misc_feature 1..9876: note = derived and/or modified CDS sequence (opt4) from DENV-2__GU131955__SS-prME
  source 1..9876: mol_type = other RNA
accgccggcgtgatcgtgatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcagcaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgccagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcatcgacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17101 - RNA, 9876 nt, synthetic construct
  misc_feature 1..9876: note = derived and/or modified CDS sequence (opt4) from DENV-2__KJ189311__SS-prME
  source 1..9876: mol_type = other RNA
accgccggcgtgatcgtgatgctgatccccaccgtgatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctggatcacctacggcacctgcagcaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgatcctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgccagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagagcatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaacctggagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaaggacgtgagagaggtgaagggcctgaccaagggcggccccggccacgaggagcccatccccatgagcacctacggctggaacctggtgagactgcagagcggcatcgacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggagaccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaagcctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagaacatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaaaggaggaggaggaggccggcgtgctgtggtga

SEQ ID NO: 17102 - RNA, 9876 nt, synthetic construct
  misc_feature 1..9876: note = derived and/or modified CDS sequence (opt4) from DENV-2__KJ189370__SS-prME
  source 1..9876: mol_type = other RNA
accgccggcgtgatcgtgatgctgatccccaccgccatggccttccacctgaccaccagaaacggcgagccccacatgatcgtgagcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgaaggagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaaggtggtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaaggccgagtacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcctgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggaccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagaggtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggtgagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17103 - RNA, 9876 nt, synthetic construct
  misc_feature 1..9876: note = derived and/or modified CDS sequence (opt4) from DENV-2__EU482620__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacaccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17104 - RNA, 9876 nt, synthetic construct
  misc_feature 1..9876: note = derived and/or modified CDS sequence (opt4) from DENV-2__FJ373300__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcaccatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccgtgctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17105 - RNA, 9876 nt, synthetic construct
  misc_feature 1..9876: note = derived and/or modified CDS sequence (opt4) from DENV-2__EU596495__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17106 - RNA, 9876 nt, synthetic construct
  misc_feature 1..9876: note = derived and/or modified CDS sequence (opt4) from DENV-2__EU596497__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccatcaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagctacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17107 - RNA, 9876 nt, synthetic construct
  misc_feature 1..9876: note = derived and/or modified CDS sequence (opt4) from DENV-2__EU569695__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccgtggccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17108 - RNA, 9876 nt, synthetic construct
  misc_feature 1..9876: note = derived and/or modified CDS sequence (opt4) from DENV-2__EU482623__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgctgctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacagcggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccatcgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17109 - RNA, 9876 nt, synthetic construct
  misc_feature 1..9876: note = derived and/or modified CDS sequence (opt4) from DENV-2__EU569698__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagacagcttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17110 - RNA, 9876 nt, synthetic construct
  misc_feature 1..9876: note = derived and/or modified CDS sequence (opt4) from DENV-2__EU569699__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccaagttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagacaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgctgctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccgtgatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccatcgaggagatcgccgtgcagaactggctggccagagtgggcagagagagactgagcagaatggccatcagcggcgacgactgcgtgatcaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17111 - RNA, 9876 nt, synthetic construct
  misc_feature 1..9876: note = derived and/or modified CDS sequence (opt4) from DENV-2__KF955366__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccagccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17112 - RNA, 9876 nt, synthetic construct
  misc_feature 1..9876: note = derived and/or modified CDS sequence (opt4) from DENV-2__EU569700__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17113 - RNA, 9876 nt, synthetic construct
  misc_feature 1..9876: note = derived and/or modified CDS sequence (opt4) from DENV-2__KF955369__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccaccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17114 - RNA, 9876 nt, synthetic construct
  misc_feature 1..9876: note = derived and/or modified CDS sequence (opt4) from DENV-2__EU569702__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagagagccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacagcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17115 - RNA, 9876 nt, synthetic construct
  misc_feature 1..9876: note = derived and/or modified CDS sequence (opt4) from DENV-2__EU482624__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggccaacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacatccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17116 - RNA, 9876 nt, synthetic construct
  misc_feature 1..9876: note = derived and/or modified CDS sequence (opt4) from DENV-2__EU596500__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatggtgatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagagcatcggcaagatgaccctgggcatgtgctgcatcatcaccgccagcatcctgctgtggcacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgttcgccatcggctgctactaccaggtgaaccccatcaccctgaccgccgccctgctgctgctggtggcccacaacgccatcatcggccagggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17117 - RNA, 9876 nt, synthetic construct
  misc_feature 1..9876: note = derived and/or modified CDS sequence (opt4) from DENV-2__EU482626__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacatccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccacccagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17118 - RNA, 9876 nt, synthetic construct
  misc_feature 1..9876: note = derived and/or modified CDS sequence (opt4) from DENV-2__EU482629__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaagatcgtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcaaggacctgggcagagtgatggtgatgatgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcatcacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaagatcagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17119 - RNA, 9876 nt, synthetic construct
  misc_feature 1..9876: note = derived and/or modified CDS sequence (opt4) from DENV-2__FJ390390__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccaagttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagacaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgctgctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccgtgatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17120 - RNA, 9876 nt, synthetic construct
  misc_feature 1..9876: note = derived and/or modified CDS sequence (opt4) from DENV-2__FJ390391__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcttcgagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17121 - RNA, 9876 nt, synthetic construct
  misc_feature 1..9876: note = derived and/or modified CDS sequence (opt4) from DENV-2__FJ882593__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccaggagagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17122 - RNA, 9876 nt, synthetic construct
  misc_feature 1..9876: note = derived and/or modified CDS sequence (opt4) from DENV-2__FJ182014__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccttcctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcatcatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17123 - RNA, 9876 nt, synthetic construct
  misc_feature 1..9876: note = derived and/or modified CDS sequence (opt4) from DENV-2__FJ547090__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccaccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagactgggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17124 - RNA, 9876 nt, synthetic construct
  misc_feature 1..9876: note = derived and/or modified CDS sequence (opt4) from DENV-2__EU482630__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccttcctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17125 - RNA, 9876 nt, synthetic construct
  misc_feature 1..9876: note = derived and/or modified CDS sequence (opt4) from DENV-2__FJ882594__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaacatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgaggccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17126 - RNA, 9876 nt, synthetic construct
  misc_feature 1..9876: note = derived and/or modified CDS sequence (opt4) from DENV-2__FJ205885__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgctgaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacaccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17127 - RNA, 9876 nt, synthetic construct
  misc_feature 1..9876: note = derived and/or modified CDS sequence (opt4) from DENV-2__FJ744743__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccggcaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgtggccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcgtgaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccaccctgctgagattcgtggcccagtacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccatcgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17128 - RNA, 9876 nt, synthetic construct
  misc_feature 1..9876: note = derived and/or modified CDS sequence (opt4) from DENV-2__JN819424__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccagcagcatcgacaacagagccgtgcacgccgacatgggctactggatggagagcgcccccagcgacagctgcaagatggagaaggccagcttcatcgaggacaagagctgctactggcccaacagccagcacctgtggagcaacggcgtgctggagagcgagatgatcttccccaagaacttcgccggccccgtgagccagcacatctacagacccggctaccacacccagaccgccggcccctgcaacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggaggccatcgacggcgagtacagactgagaggcgaggccagaaagaccttcgtggacctgatgagaagaggcgacctgcccgtgagactggcctacaaggtggccgccgagggcatcaactacgccgacagaaagtggtgcttcgacggcatcaagaacagccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17129 - RNA, 9876 nt, synthetic construct
  misc_feature 1..9876: note = derived and/or modified CDS sequence (opt4) from DENV-2__FJ744741__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggagagtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17130 - RNA, 9876 nt, synthetic construct
  misc_feature 1..9876: note = derived and/or modified CDS sequence (opt4) from DENV-2__FJ744703__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaaccgacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatccccagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17131 - RNA, 9876 nt, synthetic construct
  misc_feature 1..9876: note = derived and/or modified CDS sequence (opt4) from DENV-2__FJ850067__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccctggtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaccatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgagaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaagatcagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17132 - RNA, 9876 nt, synthetic construct
  misc_feature 1..9876: note = derived and/or modified CDS sequence (opt4) from DENV-2__FJ850060__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaagatcagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcgccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccgtgatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcagaaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcaagctgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccagggcaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17133 - RNA, 9876 nt, synthetic construct
  misc_feature 1..9876: note = derived and/or modified CDS sequence (opt4) from DENV-2__FJ850061__SS-prME
  source 1..9876: mol_type = other RNA
accgccggcgtgatcatcatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgccaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaagcccatcaccttcaccgccgccctgctgctgctggtggcccactacgccatcatcggccccggcctgcaggccaaggcccccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgaggtgcccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17134 - RNA, 9876 nt, synthetic construct
  misc_feature 1..9876: note = derived and/or modified CDS sequence (opt4) from DENV-2__FJ744709__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccgtgctggcctacaccatcggcaccacccacttccagaaggccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcatcttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacaccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcagaaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17135 - RNA, 9876 nt, synthetic construct
  misc_feature 1..9876: note = derived and/or modified CDS sequence (opt4) from DENV-2__FJ744708__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgccgagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggtgaacatcttcagcggcagctacctggccggcgccggcctgcacgtgcccctgagaaagaacaccctgagaaccagaagaggcaccggcaacaccggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17136 - RNA, 9876 nt, synthetic construct
  misc_feature 1..9876: note = derived and/or modified CDS sequence (opt4) from DENV-2__FJ810418__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcaagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatggtgatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagtggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17137 - RNA, 9876 nt, synthetic construct
  misc_feature 1..9876: note = derived and/or modified CDS sequence (opt4) from DENV-2__FJ639835__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatggtgatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagagcatcggcaagatgaccctgggcatgtgctgcatcatcaccgccagcatcctgctgtggcacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17138 - RNA, 9876 nt, synthetic construct
  misc_feature 1..9876: note = derived and/or modified CDS sequence (opt4) from DENV-2__FJ850050__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcggcaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaagtacaacagagccgtgcacgccgacatgggctactggatcgagagcgccccctgcgacagctgggagatgcagaaggccagcttcatcgaggtgatcagctgccactggcccaagagcctgaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatgcaggagcagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17139 - RNA, 9876 nt, synthetic construct
  misc_feature 1..9876: note = derived and/or modified CDS sequence (opt4) from DENV-2__FJ639837__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatggtgatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagagcatcggcaagatgaccctgggcatgtgctgcatcatcaccgccagcatcctgctgtggcacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggcccccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagaacgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtggccaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17140 - RNA, 9876 nt, synthetic construct
  misc_feature 1..9876: note = derived and/or modified CDS sequence (opt4) from DENV-2__FJ744706__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccggcagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaggcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17141 - RNA, 9876 nt, synthetic construct
  misc_feature 1..9876: note = derived and/or modified CDS sequence (opt4) from DENV-2__FJ744707__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccgtggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcaagggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacttctgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccagcaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagacagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagatcagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccaagaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggccccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17142 - RNA, 9876 nt, synthetic construct
  misc_feature 1..9876: note = derived and/or modified CDS sequence (opt4) from DENV-2__FJ744704__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatgttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatctgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17143 - RNA, 9876 nt, synthetic construct
  misc_feature 1..9876: note = derived and/or modified CDS sequence (opt4) from DENV-2__FJ744745__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgaagatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcaccctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17144 - RNA, 9876 nt, synthetic construct
  misc_feature 1..9876: note = derived and/or modified CDS sequence (opt4) from DENV-2__FJ744705__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacgacagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcatcgtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgtggagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17145 - RNA, 9876 nt, synthetic construct
  misc_feature 1..9876: note = derived and/or modified CDS sequence (opt4) from DENV-2__FJ744744__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgaagatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagagaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgttcctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgtgggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccatcatggccatcagctgcgtgcccaacgccgtgatcctgcagaacgcctggaaggtgagctgcaccatcctggccgtggtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagacccccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgagaactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccagcggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaagaagaagacccccagaatgtgcaccagagaggagttcaccagaaaggtgagaagcaacgccgccctgggcgccatcttcaccgacgagaacaagtggaagagcgccagagaggccgtggaggacagcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccccccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga

SEQ ID NO: 17146 - RNA, 9876 nt, synthetic construct
  misc_feature 1..9876: note = derived and/or modified CDS sequence (opt4) from DENV-2__GQ868646__SS-prME
  source 1..9876: mol_type = other RNA
accgccggcgtgatcgtgatgctgatccccaccgccatggccttccacctgaccaccagaaacggcgagccccacatgatcgtgggcagacaggagaagggcaagagcctgctgttcaagaccgaggacggcgtgaacatgtgcaccctgatggccatcgacctgggcgagctgtgcgaggacaccatcacctacaagtgccccctgctgagacagaacgagcccgaggacatcgactgctggtgcaacagcaccagcacctgggtgacctacggcacctgcaccaccaccggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatcatggccgccatcctggcctacaccatcggcaccacccacttccagagagccctgatcttcatcctgctgaccgccgtggcccccagcatgaccatgagatgcatcggcatcagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcatctgcaagcacagcatggtggacagaggctggggcaacggctgcggcctgttcggcaagggcggcatcgtgacctgcgccaagttcacctgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggaggacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaagatcgtgaaggagatcgccgagacccagcacggcaccatcgtgatcagagtgcagtacgagggcgacggcagcccctgcaagatccccttcgagatcaccgacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgagcctggtgctggtgggcgtggtgaccctgtacctgggcgccatggtgcaggccgacagcggctgcgtggtgagctggaagaacaaggagctgaagtgcggcagcggcatcttcatcaccgacaacgtgcacacctggaccgagcagtacaagttccagcccgagagccccagcaagctggccagcgccatccagaaggcccacgaggagggcatctgcggcatcagaagcgtgaccagactggagaacctgatgtggaagcagatcacccccgagctgaaccacatcctgagcgagaacgaggtgaagctgaccatcatgaccggcgacatcagaggcatcatgcaggccggcaagagaagcctgagaccccagcccaccgagctgaagtacagctggaagacctggggcaaggccaagatgctgagcaccgagagccacaaccagaccttcctgatcgacggccccgagaccgccgagtgccccaacaccaacagagcctggaacagcctggaggtggaggactacggcttcggcgtgttcaccaccaacatctggctgaagctgagagacaagcaggacgtgttctgcgacagcaagctgatgagcgccgccatcaaggacaacagagccgtgcacgccgacatgggctactggatcgagagcgccctgaacgacacctggaagatggagaaggccagcttcatcgaggtgaagagctgccactggcccaagagccacaccctgtggagcaacggcgtgctggagagcgagatgatcatccccaagaacttcgccggccccgtgagccagcacaactacagacccggctaccacacccagaccgccggcccctggcacctgggcaagctggagatggacttcgacctgtgcgagggcaccaccgtggtggtgaccgaggactgcggcaacagaggccccagcctgagaaccaccaccgccagcggcaagctgatcaccgagtggtgctgcagaagctgcaccctgccccccctgagatacagaggcgaggacggctgctggtacggcatggagatcagacccctgaaggagaaggaggagaacctggtgaacagcctggtgaccgccggccacggccagatcgacaacttcagcctgggcgtgctgggcatggccctgctgctggaggagatgctgagaaccagaatcggcaccaagcacgccatcctgctggtggccgtgagcttcgtgaccctgatcaccggcaacatgagcttcagagacctgggcagagtgatggtgatggtgggcgccaccatgaccgacgacatcggcatgggcgtgacctacctggccctgctggccgccttcaaggtgagacccaccttcgccgccggcctgctgctgagaaagctgaccagcaaggagctgatgatggccaccatcggcatcgccctgctgagccagagcaccatccccgagaccatcctggagctgaccgacgccctggccctgggcatgatggtgctgaagatcgtgagaaacatggagaagtaccagctggccgtgaccgtgatggccatcagctgcgtgcccaacgccgtgatcctgcagaacgcctggaaggtgagctgcaccatcctggccgccgtgagcgtgagccccctgctgctgaccagcagccagcagaaggccgactggatccccctggccctgaccatcaagggcctgaaccccaccgccatcttcctgaccaccctgagcagaaccagcaagaagagaagctggcccctgaacgaggccatcatggccgtgggcatggtgagcatcctggccagcagcctgctgaagaacgacatccccatgaccggccccctggtggccggcggcctgctgaccgtgtgctacgtgctgaccggcagaagcgccgacctggagctggagagagccgccgacgtgaagtgggaggaccaggccgagatcagcggcagcagccccatcctgagcatcaccatcagcgaggacggcagcatgagcatcaagaacgaggaggaggagcagaccctgaccatcctgatcagaaccggcctgctggtgatcagcggcgtgttccccgtgagcatccccatcaccgccgccgcctggtacctgtgggaggtgaagaagcagagagccggcgtgctgtgggacgtgcccagccccccccccgtggagaaggccgagctggaggacggcgcctacagaatcaagcagagaggcatcctgggctacagccagatcggcgccggcgtgtacaaggagggcaccttccacaccatgtggcacgtgaccagaggcgccgtgctgatgcacagaggcaagagaatcgagcccagctgggccgacgtgaagaaggacctgatcagctacggcggcggctggaagctggagggcgagtggaaggagggcgaggaggtgcaggtgctggccctggagcccggcaagaaccccagagccgtgcagaccaagcccggcatcttcaagaccaacaccggcaccatcggcgccgtgagcctggacttcagccccggcaccagcggcagccccatcgtggacagaaagggcaaggtggtgggcctgtacggcaacggcgtggtgaccagaagcggcgcctacgtgagcgccatcgcccagaccgagaagagcatcgaggacaaccccgagatcgaggacgacatcttcagaaagaagagactgaccatcatggacctgcaccccggcgccggcaagaccaagagatacctgcccgccatcgtgagagaggccatcaagagaggcctgagaaccctgatcctggcccccaccagagtggtggccgccgagatggaggaggccctgagaggcctgcccatcagataccagaccaccgccatcaagaccgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtggagatgggcgaggccgccggcatcttcatgaccgccaccccccccggcagcagagaccccttcccccagagcaacgcccccatcatggacgaggagagagagatccccgagagaagctggaacagcggccacgagtgggtgaccgacttcaagggcaagaccgtgtggttcgtgcccagcatcaaggccggcaacgacatcgccgcctgcctgagaaagaacggcaagaaggtgatccagctgagcagaaagaccttcgacagcgagtacgtgaagaccagagccaacgactgggacttcgtggtgaccaccgacatcagcgagatgggcgccaacttcaaggccgagagagtgatcgaccccagaagatgcatgaagcccgtgatcctgaccgacggcgaggagagagtgatcctggccggccccatgcccgtgacccacagcagcgccgcccagagaagaggcagaatcggcagaaaccccaagaacgagaacgaccagtacatctacatgggcgagcccctggagaacgacgaggactgcgcccactggaaggaggccaagatgctgctggacaacatcaacacccccgagggcatcatccccagcatgttcgagcccgagagagagaaggtggacgccatcgacggcgagtacagactgagaggcgaggccagaaagaccttcgtggacctgatgagaagaggcgacctgcccgtgtggctggcctacaaggtggccgccgagggcatcaactacgccgacagaaagtggtgcttcgacggcatcaagaacaaccagatcctggaggagaacatggaggtggagatctggaccaaggagggcgagagaaagaagctgaagcccagatggctggacgccagaatctacagcgaccccctggccctgaaggagttcaaggagttcgccgccggcagaaagagcctgaccctgaacctgatcaccgagatgggcagactgcccaccttcatgacccagaaggccagaaacgccctggacaacctggccgtgctgcacaccgccgaggccggcggcagagcctacaaccacgccctgagcgagctgcccgagaccctggagaccctgctgctgctgaccctgctggccaccgtgaccggcggcatcttcctgttcctgatgagcggcaagggcatcggcaagatgaccctgggcatgtgctgcatcatcaccgccagcatcctgctgtggtacgcccagatccagccccactggatcgccgccagcatcatcctggagttcttcctgatcgtgctgctgatccccgagcccgagaagcagagaaccccccaggacaaccagctgacctacgtggtgatcgccatcctgaccgtggtggccgccaccatggccaacgagatgggcttcctggagaagaccaagaaggacctgggcctgggcagcatcaccacccaggagagcgagagcaacatcctggacatcgacctgagacccgccagcgcctggaccctgtacgccgtggccaccaccttcgtgacccccatgctgagacacagcatcgagaacagcagcgtgaacgtgagcctgaccgccatcgccaaccaggccaccgtgctgatgggcctgggcaagggctggcccctgagcaagatggacatcggcgtgcccctgctggccatcggctgctacagccaggtgaaccccatcaccctgaccgccgccctgctgctgctggtggcccactacgccatcatcggccccggcctgcaggccaaggccaccagagaggcccagaagagagccgccgccggcatcatgaagaaccccaccgtggacggcatcaccgtgatcgacctggagcccatcccctacgaccccaagttcgagaagcagctgggccaggtgatgctgctgatcctgtgcgtgacccaggtgctgatgatgagaaccacctgggccctgtgcgaggccctgaccctggccaccggccccatcagcaccctgtgggagggcaaccccggcagattctggaacaccaccatcgccgtgagcatggccaacatcttcagaggcagctacctggccggcgccggcctgctgttcagcatcatgaagaacaccaccaacaccagaagaggcaccggcaacatcggcgagaccctgggcgagaagtggaagagcagactgaacgccctgggcaagagcgagttccagatctacaagaagagcggcatccaggaggtggacagaaccctggccaaggagggcatcaagagaggcgagaccgaccaccacgccgtgagcagaggcagcgccaagctgagatggttcgtggagagaaacatggtgacccccgagggcaaggtggtggacctgggctgcggcagaggcggctggagctactactgcggcggcctgaagaacgtgagagaggtgaagggcctgaccaagggcggccccggccacgaggagcccatccccatgagcacctacggctggaacctggtgagactgcagagcggcgtggacgtgttcttcaccccccccgagaagtgcgacaccctgctgtgcgacatcggcgagagcagccccaaccccaccatcgaggccggcagaaccctgagagtgctgaacctggtggagaactggctgaacaacaacacccagttctgcatcaaggtgctgaacccctacatgcccagcgtgatcgagaagatggaggccctgcagagaaagtacggcggcgccctggtgagaaaccccctgagcagaaacagcacccacgagatgtactgggtgagcaacgccaccggcaacatcgtgagcagcgtgaacatgatcagcagaatgctgatcaacagattcaccatgaagcacaagaaggccacctacgagcccgacgtggacctgggcagcggcaccagaaacatcggcatcgagagcgagatccccaacctggacatcatcggcaagagaatcgagaagatcaagcaggagcacgagaccagctggcactacgaccaggaccacccctacaagacctgggcctaccacggcagctacgagaccaagcagaccggcagcgccagcagcatggtgaacggcgtggtgagactgctgaccaagccctgggacgtggtgcccatggtgacccagatggccatgaccgacaccacccccttcggccagcagagagtgttcaaggagaaggtggacaccagaacccaggagcccaaggagggcaccaagaagctgatgaagatcaccgccgagtggctgtggaaggagctgggcaaggagaagacccccagaatgtgcaccagagaggagttcaccagaaaggtgagaagcaacgccgccctgggcgccatcttcaccgacgagaacaagtggaagagcgccagagaggccgtggaggacggcagattctgggagctggtggacagagagagaaacctgcacctggagggcaagtgcgagacctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagaggcaacagcctgagcggcgtggagggcgagggcctgcacagactgggctacatcctgagagacgtgggcaagaaggagggcggcgccatgtacgccgacgacaccgccggctgggacaccagaatcaccctggaggacctgaagaacgaggagatggtgaccaaccacatgaagggcgagcacaagaagctggccgaggccatcttcaagctgacctaccagaacaaggtggtgagagtgcagagacccacccccagaggcaccgtgatggacatcatcagcagaagagaccagagaggcagcggccaggtgggcacctacggcctgaacaccttcaccaacatggaggcccagctgatcagacagatggagggcgagggcatcttcaagagcatccagcacctgaccgccaccgaggagatcgccgtgcagaactggctggccagagtgggcagagagagactgagcagaatggccatcagcggcgacgactgcgtggtgaagcccatcgacgacagattcgccagcgccctgaccgccctgaacgacatgggcaaggtgagaaaggacatccagcagtgggagcccagcagaggctggaacgactggacccaggtgcccttctgcagccaccacttccacgagctggtgatgaaggacggcagagtgctggtggtgccctgcagaaaccaggacgagctgatcggcagagccagaatcagccagggcgccggctggagcctgaaggagaccgcctgcctgggcaagagctacgcccagatgtggaccctgatgtacttccacagaagagacctgagactggccgccaacgccatctgcagcgccgtgcccagccactgggtgcccaccagcagaaccacctggagcatccacgccaagcacgagtggatgaccaccgaggacatgctggccgtgtggaacagagtgtggatccaggagaacccctggatggaggacaagacccccgtggagagctgggaggaggtgccctacctgggcaagagagaggaccagtggtgcggcagcctgatcggcctgaccagcagagccacctgggccaagaacatccagaccgccatcaaccaggtgagaagcctgatcggcaacgaggagtacaccgactacatgcccagcatgaagagattcagaagagaggaggaggaggccggcgtgctgtggtga
